(12) United States Patent  (10) Patent No.: US 8,927,249 B2
Wei et al. (45) Date of Patent: Jan. 6, 2015

(54) EXTENDED SOLUBLE PH20 POLYPEPTIDES AND USES THEREOF

(75) Inventors: Ge Wei, San Diego, CA (US); Krishnasamy Panneer Selvam, Poway, CA (US); Louis Bookbinder, San Diego, CA (US); Gregory I. Frost, Del Mar, CA (US)

(73) Assignee: Halozyme, Inc., San Diego, CA (US)

( * ) Notice: Subject to any disclaimer, the term of this patent is extended or adjusted under 35 U.S.C. 154(b) by 435 days.

(21) Appl. No.: 12/653,245

(22) Filed: Dec. 9, 2009

(65) Prior Publication Data

US 2010/0143457 A1  Jun. 10, 2010

Related U.S. Application Data

(60) Provisional application No. 61/281,240, filed on Nov. 13, 2009, provisional application No. 61/201,384, filed on Dec. 9, 2008.

(51) Int. Cl.
| | | |
|---|---|---|
| *C12N 9/26* | (2006.01) | |
| *A61K 38/47* | (2006.01) | |
| *A61K 47/48* | (2006.01) | |
| *A61K 38/00* | (2006.01) | |

(52) U.S. Cl.
CPC ........ *C12N 9/2408* (2013.01); *A61K 47/48215* (2013.01); *A61K 47/4823* (2013.01); *A61K 47/48292* (2013.01); *C12N 9/2474* (2013.01); *A61K 38/00* (2013.01)
USPC ........................................ 435/200; 424/94.61

(58) Field of Classification Search
None
See application file for complete search history.

(56) References Cited

U.S. PATENT DOCUMENTS

| | | | | |
|---|---|---|---|---|
| 3,536,809 | A | 10/1970 | Applezweig | 424/435 |
| 3,598,123 | A | 8/1971 | Zaffaroni | 424/435 |
| 3,630,200 | A | 12/1971 | Higuchi | 424/427 |
| 3,710,795 | A | 1/1973 | Higuchi et al. | 424/424 |
| 3,845,770 | A | 11/1974 | Theeuwes et al. | 424/427 |
| 3,847,770 | A | 11/1974 | Radlowe et al. | 427/511 |
| 3,916,899 | A | 11/1975 | Theeuwes et al. | 424/424 |
| RE28,819 | E | 5/1976 | Thompson | 514/174 |
| 4,002,531 | A | 1/1977 | Royer | 435/188 |
| 4,008,719 | A | 2/1977 | Theeuwes et al. | 424/427 |
| 4,044,126 | A | 8/1977 | Cook et al. | 514/180 |
| 4,179,337 | A | 12/1979 | Davis et al. | 435/181 |
| 4,364,923 | A | 12/1982 | Cook et al. | 424/46 |
| 4,414,209 | A | 11/1983 | Cook et al. | 514/180 |
| 4,687,610 | A | 8/1987 | Vassilatos | 264/211.14 |
| 4,769,027 | A | 9/1988 | Baker et al. | 424/493 |
| 4,952,496 | A | 8/1990 | Studier et al. | 435/91.41 |
| 5,033,252 | A | 7/1991 | Carter | 53/425 |
| 5,052,558 | A | 10/1991 | Carter | 206/439 |
| 5,059,595 | A | 10/1991 | Le Grazie | 424/468 |
| 5,073,543 | A | 12/1991 | Marshall et al. | 514/21 |
| 5,116,615 | A | 5/1992 | Gokcen et al. | 424/94.2 |
| 5,120,548 | A | 6/1992 | McClelland et al. | 424/473 |
| 5,122,614 | A | 6/1992 | Zalipsky | 548/520 |
| 5,183,550 | A | 2/1993 | Mattiessen | 204/415 |
| 5,292,509 | A | 3/1994 | Hageman | 424/94.61 |
| 5,323,907 | A | 6/1994 | Kalvelage | 206/531 |
| 5,324,844 | A | 6/1994 | Zalipsky | 548/520 |
| 5,354,566 | A | 10/1994 | Addesso et al. | 426/9 |
| 5,446,090 | A | 8/1995 | Harris | 525/54.1 |
| 5,591,767 | A | 1/1997 | Mohr et al. | 514/413 |
| 5,612,460 | A | 3/1997 | Zalipsky | 530/391.9 |
| 5,639,476 | A | 6/1997 | Oshlack et al. | 424/468 |
| 5,643,575 | A | 7/1997 | Martinez et al. | 424/194.1 |
| 5,665,069 | A | 9/1997 | Cumer et al. | 604/116 |
| 5,672,662 | A | 9/1997 | Harris et al. | 525/408 |
| 5,674,533 | A | 10/1997 | Santus et al. | 424/493 |
| 5,705,364 | A | 1/1998 | Etcheverry et al. | 435/70.3 |
| 5,721,348 | A | 2/1998 | Primakoff et al. | 536/22.1 |
| 5,733,566 | A | 3/1998 | Lewis | 424/426 |
| 5,766,581 | A | 6/1998 | Bartley et al. | 424/85.1 |
| 5,795,569 | A | 8/1998 | Bartley et al. | 424/85.1 |
| 5,808,096 | A | 9/1998 | Zalipsky | 548/520 |
| 5,854,046 | A | 12/1998 | Au-Young et al. | 435/201 |
| 5,900,461 | A | 5/1999 | Harris | 525/54.11 |
| 5,919,455 | A | 7/1999 | Greenwald et al. | 424/178.1 |
| 5,932,462 | A | 8/1999 | Harris et al. | 435/188 |
| 5,958,750 | A | 9/1999 | Au-Young et al. | 435/201 |
| 5,985,263 | A | 11/1999 | Lee et al. | 424/85.2 |
| 5,990,237 | A | 11/1999 | Bentley et al. | 525/54.2 |
| 6,057,110 | A | 5/2000 | Au-Young et al. | 435/6 |
| 6,103,525 | A | 8/2000 | Stern et al. | 435/326 |
| 6,113,906 | A | 9/2000 | Greenwald et al. | 424/194.1 |
| 6,123,938 | A | 9/2000 | Stern et al. | 424/94.62 |

(Continued)

FOREIGN PATENT DOCUMENTS

| | | |
|---|---|---|
| CA | 2318356 | 7/2000 |
| EP | 0400472 | 12/1990 |

(Continued)

OTHER PUBLICATIONS

Galye et al, Identification of regions in interleukin-1 alpha important for activity. J Biol Chem. Oct. 15, 1993;268(29):22105-11.*
Whisstock et al, Prediction of protein function from protein sequence and structure. Q Rev Biophys. Aug. 2003;36(3):307-40. Review.*
Undenfriend et al, Prediction of omega site in nascent precursor of glycosylphosphatidylinositol protein. Methods Enzymol. 1995;250:571-82.*
Moran et al, Glycophospholipid membrane anchor attachment. Molecular analysis of the cleavage/attachment site. J Biol Chem. Jan. 15, 1991;266(2):1250-7.*
Dyson et al, Production of soluble mammalian proteins in Escherichia coli: identification of protein features that correlate with successful expression. BMC Biotechnol. Dec. 14, 2004;4:32.*
Willard et al, Expression, purification, and characterization of the human receptor activator of NF-kappaB ligand (RANKL) extracellular domain. Protein Expr Purif. Oct. 2000;20(1):48-57.*

(Continued)

*Primary Examiner* — Sheridan Swope
(74) *Attorney, Agent, or Firm* — McKenna Long & Aldridge LLP; Stephanie Seidman

(57) ABSTRACT

Soluble PH20 polypeptides are provided, including extended soluble PH20 polypeptides, and uses thereof. Also provided are other C-terminally truncated PH20 polypeptides and partially deglycosylated PH20 polypeptides and uses thereof.

37 Claims, 6 Drawing Sheets

(56) References Cited

U.S. PATENT DOCUMENTS

| | | | |
|---|---|---|---|
| 6,193,963 B1 | 2/2001 | Stern et al. | 424/94.62 |
| 6,214,966 B1 | 4/2001 | Harris | 528/322 |
| 6,258,351 B1 | 7/2001 | Harris | 424/78.3 |
| 6,340,742 B1 | 1/2002 | Burg et al. | 530/351 |
| 6,413,507 B1 | 7/2002 | Bentley et al. | 424/78.02 |
| 6,420,339 B1 | 7/2002 | Gegg et al. | 514/12 |
| 6,437,025 B1 | 8/2002 | Harris et al. | 523/406 |
| 6,448,369 B1 | 9/2002 | Bentley et al. | 528/425 |
| 6,461,802 B1 | 10/2002 | Van Thillo et al. | 430/336 |
| 6,461,863 B1 | 10/2002 | Jarvis | 435/320.1 |
| 6,495,659 B2 | 12/2002 | Bentley et al. | 528/425 |
| 6,552,170 B1 | 4/2003 | Thompson et al. | 530/351 |
| 6,682,904 B1 | 1/2004 | Frost | 435/18 |
| 6,737,505 B2 | 5/2004 | Bentley et al. | 528/425 |
| 6,745,776 B2 | 6/2004 | Soll | 128/898 |
| 6,828,401 B2 | 12/2004 | Nho et al. | 526/333 |
| 6,828,431 B2 | 12/2004 | Frudakis et al. | 536/23.1 |
| 6,858,736 B2 | 2/2005 | Nho et al. | 546/290 |
| 7,015,253 B2 | 3/2006 | Escandon et al. | 514/724 |
| 7,105,330 B2 | 9/2006 | Stern et al. | 435/200 |
| 7,148,201 B2 | 12/2006 | Stern et al. | 514/44 |
| 7,368,108 B2 | 5/2008 | DeFrees et al. | 424/94.5 |
| 7,544,499 B2 | 6/2009 | Frost et al. | 435/200 |
| 7,601,335 B2 | 10/2009 | McCutcheon et al. | 424/9.2 |
| 7,718,428 B2 | 5/2010 | Frost et al. | 435/375 |
| 7,767,429 B2 | 8/2010 | Frost et al. | 435/201 |
| 7,781,397 B2 | 8/2010 | Stern et al. | 424/94.62 |
| 7,829,081 B2 | 11/2010 | Bookbinder et al. | 424/94.62 |
| 7,846,431 B2 | 12/2010 | Bookbinder et al. | 424/94.62 |
| 7,871,607 B2 | 1/2011 | Bookbinder et al. | 424/94.62 |
| 7,914,542 B2 | 3/2011 | Lamson et al. | 606/139 |
| 8,105,586 B2 | 1/2012 | Bookbinder et al. | 424/94.3 |
| 8,187,855 B2 | 5/2012 | Baker et al. | 435/201 |
| 8,257,699 B2 | 9/2012 | Bookbinder et al. | 424/94.62 |
| 8,343,487 B2 | 1/2013 | Baker et al. | 424/94.62 |
| 8,431,124 B2 | 4/2013 | Bookbinder et al. | 424/94.62 |
| 8,431,380 B2 | 4/2013 | Bookbinder et al. | 435/201 |
| 8,450,470 B2 | 5/2013 | Bookbinder et al. | 536/23.2 |
| 8,580,252 B2 | 11/2013 | Bookbinder et al. | 424/85.2 |
| 8,765,685 B2 | 7/2014 | Bookbinder et al. | 514/20.9 |
| 8,772,246 B2 | 7/2014 | Bookbinder et al. | 435/200 |
| 2001/0021763 A1 | 9/2001 | Harris | 528/75 |
| 2001/0044526 A1 | 11/2001 | Shen | 530/409 |
| 2001/0046481 A1 | 11/2001 | Bentley et al. | 424/78.18 |
| 2002/0052430 A1 | 5/2002 | Harris et al. | 523/406 |
| 2002/0072573 A1 | 6/2002 | Bentley et al. | 525/409 |
| 2002/0156047 A1 | 10/2002 | Zhao | 514/58 |
| 2003/0114647 A1 | 6/2003 | Harris et al. | 530/402 |
| 2003/0143596 A1 | 7/2003 | Bentley et al. | 435/6 |
| 2003/0157108 A1 | 8/2003 | Presta | 424/145.1 |
| 2003/0158333 A1 | 8/2003 | Roberts et al. | 525/54.11 |
| 2003/0170243 A1 | 9/2003 | Stern et al. | 424/146.1 |
| 2003/0212021 A1 | 11/2003 | Frost et al. | 514/44 R |
| 2003/0220447 A1 | 11/2003 | Harris | 525/54.1 |
| 2004/0013637 A1 | 1/2004 | Bentley et al. | 424/78.17 |
| 2004/0096921 A1 | 5/2004 | Stern et al. | 435/7.92 |
| 2004/0235734 A1 | 11/2004 | Bossard et al. | 514/12 |
| 2004/0268425 A1 | 12/2004 | Bookbinder et al. | 800/18 |
| 2005/0114037 A1 | 5/2005 | Desjarlais et al. | 702/19 |
| 2005/0171328 A1 | 8/2005 | Harris | 528/322 |
| 2005/0209416 A1 | 9/2005 | Harris | 525/523 |
| 2005/0260186 A1 | 11/2005 | Bookbinder et al. | 424/94.61 |
| 2005/0260711 A1 | 11/2005 | Datta et al. | 435/69.1 |
| 2005/0287134 A1 | 12/2005 | Klein | 424/94.61 |
| 2006/0104968 A1 | 5/2006 | Bookbinder et al. | 424/94.61 |
| 2006/0247201 A1 | 11/2006 | Frost et al. | 514/44 R |
| 2007/0067855 A1 | 3/2007 | Jarvis et al. | 800/13 |
| 2007/0134228 A1 | 6/2007 | Stern et al. | 424/94.61 |
| 2007/0148156 A1 | 6/2007 | Frost et al. | 424/94.61 |
| 2009/0018523 A1 | 1/2009 | Lamson et al. | 604/56 |
| 2009/0123367 A1 | 5/2009 | Bookbinder et al. | 424/1.49 |
| 2009/0181013 A1 | 7/2009 | Bookbinder et al. | 424/130.1 |
| 2009/0181032 A1 | 7/2009 | Bookbinder et al. | 424/141.1 |
| 2009/0214505 A1 | 8/2009 | Bookbinder et al. | 424/94.1 |
| 2009/0253175 A1 | 10/2009 | Bookbinder et al. | 435/69.1 |
| 2009/0304665 A1 | 12/2009 | Frost et al. | 424/94.5 |
| 2009/0311237 A1 | 12/2009 | Frost | 424/94.62 |
| 2010/0003237 A1 | 1/2010 | Keller et al. | 424/94.62 |
| 2010/0003238 A1 | 1/2010 | Frost et al. | 424/94.62 |
| 2010/0015698 A1 | 1/2010 | Frost et al. | |
| 2010/0074885 A1 | 3/2010 | Schiff et al. | 424/130.1 |
| 2010/0172892 A1 | 7/2010 | Uvarkina et al. | 424/94.62 |
| 2010/0184845 A1 | 7/2010 | Frost et al. | 514/44 R |
| 2010/0196423 A1 | 8/2010 | Bookbinder et al. | 424/247.1 |
| 2010/0211015 A1 | 8/2010 | Bookbinder et al. | 604/187 |
| 2010/0284995 A1 | 11/2010 | Bookbinder et al. | |
| 2011/0008309 A1 | 1/2011 | Bookbinder et al. | 424/94.3 |
| 2011/0053247 A1 | 3/2011 | Baker et al. | 435/201 |
| 2011/0152359 A1 | 6/2011 | Bookbinder et al. | 435/200 |
| 2011/0212074 A1 | 9/2011 | Frost et al. | 424/85.1 |
| 2012/0020951 A1 | 1/2012 | Shepard et al. | 424/130.1 |
| 2012/0093770 A1 | 4/2012 | Bookbinder et al. | 424/94.62 |
| 2012/0148555 A1 | 6/2012 | Bookbinder et al. | 435/200 |
| 2012/0171153 A1 | 7/2012 | Frost et al. | 424/94.62 |
| 2012/0196348 A1 | 8/2012 | Baker et al. | 424/94.62 |
| 2012/0213767 A1 | 8/2012 | Wei et al. | 424/450 |
| 2012/0251517 A1 | 10/2012 | Frost et al. | 424/94.62 |
| 2012/0251620 A1 | 10/2012 | Bookbinder et al. | 424/450 |
| 2012/0294830 A1 | 11/2012 | Bookbinder et al. | 424/85.2 |
| 2013/0011378 A1 | 1/2013 | Yang et al. | 424/94.3 |
| 2013/0022588 A1 | 1/2013 | Yang et al. | 424/94.3 |
| 2013/0022592 A1 | 1/2013 | Vaughn et al. | 424/94.62 |
| 2013/0058893 A1 | 3/2013 | Bookbinder et al. | 435/200 |
| 2013/0101577 A9 | 4/2013 | Wei et al. | 424/450 |
| 2013/0202583 A1 | 8/2013 | Jiang et al. | 424/94.62 |
| 2013/0251786 A1 | 9/2013 | Li et al. | 424/94.62 |
| 2013/0302275 A1 | 11/2013 | Wei et al. | 424/94.62 |
| 2013/0302400 A1 | 11/2013 | Maneval et al. | 435/195 |
| 2014/0037613 A1 | 2/2014 | Bookbinder et al. | 424/94.62 |
| 2014/0135682 A1 | 5/2014 | Frost et al. | 424/94.5 |
| 2014/0199282 A1 | 7/2014 | Bookbinder et al. | 435/200 |

FOREIGN PATENT DOCUMENTS

| | | | |
|---|---|---|---|
| EP | 0822199 | 9/2004 | |
| EP | 01064951 | 8/2007 | |
| JP | 6-503721 | 4/1994 | |
| WO | WO 88/02261 | 4/1988 | |
| WO | WO 94/28024 | 12/1994 | |
| WO | WO 00/02017 | 1/2000 | |
| WO | WO 01/87925 | 4/2001 | |
| WO | WO 02/49673 | 6/2002 | |
| WO | WO 2004/056312 | 7/2004 | |
| WO | WO 2004/078140 | 9/2004 | |
| WO | WO 2006/091871 | 8/2006 | |
| WO | WO2006091871 | * 8/2006 | C07K 16/00 |
| WO | WO 2006/133553 | 12/2006 | |
| WO | WO 2008/101098 | 8/2008 | |
| WO | WO 2009/111066 | 9/2009 | |
| WO | WO 2009/111083 | 9/2009 | |
| WO | WO 2009/117085 | 9/2009 | |
| WO | WO 2009/128917 | 10/2009 | |
| WO | WO 2009/128918 | 10/2009 | |
| WO | WO 2009/134380 | 11/2009 | |

OTHER PUBLICATIONS

MacLean et al, Hyaluronidase-induced reductions in myocardial infarct size. Science. Oct. 8, 1976;194(4261):199-200.*

Halozyme Therapeutics, Inc. Halozyme Therapeutics Presents Positive Pre-Clinical Single Agent Data for PEGPH20. 2009.*

Frost G., "Subcutaneous strategies for monoclonal antibody delivery," IBC Life Sciences Antibodies and Beyond Antibodies: Optimizing Antibody Leads and Exploring Next Generation Scaffolds for Protein Therapeutics, Coronado CA, 2006 [20 pages].

Gohllce et al., "Analysis of site-specific N-glycosylation of recombinant Desmodus rotundus salivary plasminogen activator rDSPalphal expressed in Chinese hampster ovary cells," Glycobiology 7(1):67-77 (1997).

Greenbaum S. The first use of recombinant human hyaluronidase in cataract surgery anesthesia: A pilot study,Poster presented at: Annual Meeting of the American Academy of Ophthalmology; Nov. 10-13, 2007; New Orleans, LA. 1 page.

(56) References Cited

OTHER PUBLICATIONS

Haller et al., "Recombinant Human Hyaluronidase for the Interstitial Transport of Therapeutics," Controlled Release Society Conference, Vienna, Austria, 2006, 2 pages.

Haller et al., "Revolutionizing Drug Dispersion with Enhanze Technology," American Association of Pharmaceutical Scientists Annual Meeting, Nov. 6-10, 2005 poster, Nashville, TN, poster, 1 page.

Haller, M., "Enzyme-facilitated Parenteral Drug Transport." Strategic Research Institute's 10th Anniversary Drug Delivery Technology and Deal-making Summit, 2005 New Brunswick, NJ [24 pages].

Hompesch et al., "Accelerated Insulin Pharmacokinetics and Improved Glycemic Control in T1DM Patients by Coadministration of Prandial Insulin with Recombinant Human Hyaluronidase" Part 2, European Association for the Study of Diabetes, Sep. 29-Oct. 2, 2009 [1 page].

Jefferies Investor Presentation "Matrix Therapies for Life" New York, Jun. 17, 2009 [30 pages].

Jiang et al., "A Comparative Study of Hyaluronan in Tumors Derived from BBN Induced Rat Bladder Carcinomas and Human Bladder TCC." Hyaluronan (ISHAS) 2007, Charleston, SC. 15 pages.

Jiang et al., "Effects of Recombinant Human PH20 (rHuPH20) on Interstitial Matrices: Creating a Favorable Environment for the Delivery of Cytostatic Agents," Proceedings of the 96th Annual Meeting of the American Association for Cancer Research; vol. 46, p. 1198, Abstract nr 5075; Presented in Anaheim, CA.:AACR; Apr. 16-20, 2005.

Li et al., "Importance of Glycosylation and Disulfide Bonds in Hyaluronidase Activity of Macaque Sperm Surface PH-20." J. Androl. 23:211-219 (2002).

Meyer et al., "The soluble hyaluronidase from bull testes is a fragment of the membrane-bound PH-20 enzyme." FEBS Letters 413(2):385-388 (1997).

Nagy et al., "Prospective study on rHuPH20." European Society of Human Reproduction & Embryology Annual Meeting, Jun. 19-22, 2005, Copenhagen, Denmark. Abstract O-213.

New Release, "Halozyme Therapeutics Reports Fourth Quarter and Year End 2008 Financial Results," Mar. 13, 2009, retrieved from: www.sec.gov/Archives/edgar/data/1159036/000129993309001189/exhibit1.htm [retrieved on Mar. 30, 2010] [5 pages].

News Release, Halozyme Therapeutics Inc., "Halozyme Therapeutics Reports Second Quarter Financial Results" Aug. 16, 2004, retrieved from the Internet:<URL: sec.gov/Archives/edgar/data/1159036/000095013704006885/a01296exv99w2.txt, [retrieved on Mar. 29, 2010] [3 pages].

News Release, Halozyme Therapeutics Inc., "Halozyme Therapeutics Reports Third Quarter 2004 Financial Results" Nov. 12, 2004, retrieved from the Internet:<URL: sec.gov/Archives/edgar/data/1159036/000095013704009868/a03367exv99w1.txt, [retrieved on Mar. 29, 2010] [4 pages].

News Release, Halozyme Therapeutics Inc., "Halozyme Therapeutics Reports Second Quarter 2009 Financial Results" Aug. 7, 2009, retrieved from the Internet:<URL: www.sec.gov/Archives/edgar/data/1159036/000129993309003275/exhibit1.htm, [retrieved on Mar. 30, 2010] [5 pages].

News Release, Halozyme Therapeutics Inc., "Halozyme Therapeutics Reports 2008 Second Quarter Financial Results" Aug. 8, 2008, retrieved from the Internet<URL: http://www.sec.gov/Archives/edgar/data/1159036/000129993308003838/exhibit1.htm, [retrieved on Mar. 31, 2010] [5 pages].

News Release, Halozyme Therapeutics Inc., "Halozyme Therapeutics, Inc. Study Results Show Faster Insulin Absorption When Administered in Combination With Wide Range of PH20 Enzyme Concentrations" Oct. 21, 2009, retrieved from: http://in.reuters.com/money/quotes/keyDevelopments?symbol=HALO.O [retrieved on Apr. 27, 2010] [1 page].

News Release, Halozyme Therapeutics Inc., "Halozyme Therapeutics, Inc. Begins Phase 1 Clinical Study With PEGPH20 in Cancer Patients With Refractory Solid Tumors" Mar. 31, 2009, retrieved from: http://in.reuters.com/money/quotes/keyDevelopments?symbol=HALO.O [retrieved on Apr. 27, 2010] [1 page].

"Pharmacokinetic and Glucodynamic Crossover Study of SC Administered Insulin Lispro + rHuPH20 and Regular Human Insulin + rHuPH20 Compared to Lispro alone," found at: http://clinicaltrials.gov/ct2/show/NCT00862849, [accessed on Apr. 26, 2010] [4 pages].

Thomas et al., "HYLNEX Recombinant Hyaluronidase Human Injection Dose-Comparison Study of Subcutaneous Hydration: The INFUSE-LR Study." Cleveland Clinic Palliative Medicine, 2006, Sarasota, FL.

Yocum et al., "Phase IV study of the PK, safety and tolerability of HUMIRA administered with escalating doses of recombinant human hyaluronidase (rHuPH20); an Enhanze Technology Study with a Large Protein Molecule Therapeutic." Controlled Release Society Conference. Long Beach, CA, Jul. 9, 2007 [20 pages].

Letter/Written Disclosure of the Information Disclosure Statement for the above referenced application, mailed on Oct. 4, 2011, 2 pages.

Aaltomaa et al., "Strong stromal hyaluronan expression is associated with PSA recurrence in local prostate cancer," Urol Int 69:266-272 (2002).

Alonso-Magdalena et al., "A role for epithelial-mesenchymal transition in the etiology of benign prostatic hyperplasia," Proc Natl Acad Sci USA 106:2859-2863 (2009).

Gakunga et al., "Hyaluronan is a preprequisite for ductal branching morphogenesis," Development 124:3987-3997 (1997).

Gerber et al., "Phosphatidylinositol Glycan (PI-G) anchored membrane proteins," J. Biol. Chem. 267(17):12168-12178 (1992).

Goya et la., "Local injection of a sustained-release antiandrogen formulation into a target prostatic site: an experimental study," BJU International 99:202-206 (2007).

Harmon et al., "Transurethral enzymatic ablation of the prostate: canine model," Urology 48:229-233 (1996).

Hooper, N., "Determination of glycosyl-phosphatidylinositol membrane protein anchorage," Proteomics 1:748-755 (2001).

Kodukula et al., "Biosynthesis of phosphatidylinositol glycan-anchored membrane proteins" J. Biol. Chem. 266:4464-4470 (1991).

Lokeshwar et al., "Stromal and epithelial expression of tumor markers hualuronic acid and HYAL1 hyaluronidase in prostate cancer," J Biol Chem 276:11922-11932 (2001).

Low, M., "Biochemistry of the glycosyl-phosphatidylinositol membrane protein anchors," Biochem. J. 224:1-13 (1987).

Saemi, A. and M. Plante, "Injectables in the prostate," Current Opinion in Urology 18:28-33 (2008).

Zhang et al., "Ablation of canine prostate using two-stage intraprostatic hot agarose solution and enzyme injection," Prostate Cancer and Prostatic Diseases 7:316-320 (2004).

Frost, G., Investor Presentation Jefferies 2011 Global Healthcare Conference, Jun. 9, 2011, New York, NY, 22 pages.

Halozyme Therapeutics, J.P. Morgan 29th Annual Healthcare Conference Presentation, Jan. 12, 2011, 35 pages.

Halozyme Therapeutics, "Matrix therapies for life" Presented at Canaccord Cardiovascular, Diabetes & Obesity Conference, Dec. 8, 2010, 38 pages.

Halozyme Therapeutics, Analyst and Investor Meeting presentations, "Matrix Therapeutics for Life" Presented Dec. 14, 2010 in New York, Presentation, 124 pages.

Kang et al., "Chronic treatment with PEGylated human recombinant PH20 hyaluronidase (PEGPH20) reverses diet-induced insulin resistance (IR) in mice," ADA May 2011, Abstract, 1 page.

Kang et al., "Chronic treatment with PEGylated human recombinant PH20 hyaluronidase (PEGPH20) reverses diet-induced insulin resistance (IR) in mice," American Diabetes Association May 2011, Oral presentation, 21 pages.

Lee et al., "Subcutaneous immunoglobulin administration using recombinant human hyaluronidase: a novel approach for the treatment of peripheral neuropathies in children," [online][retrieved on Jul. 12, 2010] Retrieved from:<URL:icnc2010.org/index.php?option=com_content&view=article&id=163&Itemid=9, 1 page.

Li et al, "PEGylated human recombinant hyaluronidase (PEGPH20) removes peritumoral hyaluronan and increases the efficacy of che-

(56) References Cited

OTHER PUBLICATIONS motherapy and radiotherapy in an experimental brain metastisis model," ASCR Apr. 13, 2009. Poster, 1 page.
Li et al., "PEGylated human recombinant hyaluronidase PH20 (PEGPH20) combined with finasteride inhibits rat prostatic hyperplasia in the rat testosterone enanthate prostatic hyperplasia model," Western Section American Urological Association—WSAUA meeting, Waikoloa, HI., Oct. 23-29, 2010. Abstract submitted Jun. 14, 2010, 1 page.
Li et al., "PEGylated human recombinant hyaluronidase PH20 (PEGPH20) combined with finasteride inhibits rat prostatic hyperplasia in the rat testosterone enanthate BPH model," Western Section American Urological Association—WSAUA meeting, Waikoloa, HI., Oct. 23-29, 2010 Poster Presented Oct. 24, 2010, 1 page.
Muchmore et al., "Recombinant human hyaluronidase (rHuPH20) accelerates rapid insulin analog pharmacokinetics (PK) when delivered either by subcutaneous injection or by continuous subcutaneous insulin infusion (CSII)," Presented at AACE Apr. 14, 2011, Oral presentation, 27 pages.
Muchmore et al., "Human hyaluronidase coinjection consistently accelerates prandial insulin pharmacokinetics (PK) and glucodynamics (GD) across studies and populations," [online][retrieved on Jun. 22, 2011] Retrieved from: <URL: halozyme.com/ADA%202011Consistency%20Poster%20v2.1.pdf, [2 pages].
Muchmore et al., "Improved consistency of pharmacokinetic (PK) and glucodynamic (GD) responses using recombinant human hyaluronidase (rHuPH20) pretreatment with continuous subcutaneous insulin infusion (CSII) in type 1 diabetes (T1DM)," Diabetes Technology Society Meeting Oct. 27-29, 2011, San Francisco, CA., 1 page.
Shepard et al., "Targeting hyaluronan (HA) in the tumor stroma. Translational evaluation of pegylated hyaluronidase (PEGPH20) in animal models and patients with advanced solid tumors" EORTC-ASCO-NCI meeting Hollywood, FL., Oct. 19, 2010, 1 page.
Shepard et al.,"Hyaluronan: the glue that holds a tumor together," Biotherapeutic Targets, Boston, MA, May 21, 2010, 26 pages.
Singha et al., "Enzymatic depletion of pericellular HA sensitize antibody dependent cell-mediated cytotoxicity," presented at AACR Apr. 2011, published Mar. 2011, Abstract, 2 pages.
Sumit et al., "Chemonucleolysis with recombinant human hyaluronidase: effective as chymopapain," AAOS Feb. 15-19, 2011 meeting San Diego, CA., Abstract, 1 page.
Response of Oct. 7, 2010 to the Written Opinion, issued Apr. 20, 2010, in connection International Patent Application No. PCT/US2009/006501, 34 pages.
International Preliminary Report on Patentability, issued Feb. 15, 2011, in connection with International Patent Application No. PCT/US2009/006501.
Examination Report, issued Jul. 19, 2011, in connection with New Zealand Patent Application No. 593641, 13 pages.
U.S. Appl. No. 13/135,817, filed Jul. 15, 2011.
Letter/Written Disclosure of the Supplemental Information Disclosure Statement for the above-referenced application, mailed on Aug. 20, 2012, 2 pages.
Alberts, B., *Molecular Biology of the Cell*, Garland Publishing Inc. New York and London, 3rd ed., p. 347 (1983).
Chain, E. and E. Duthie, "A mucolytic enzyme in testis extracts," Nature 144:977-978 (1939).
Kyte, J. and R. Doolittle, "A simple method for displaying the hydropathic character of a protein," J. Mol. Biol. 157:105-132 (1982).
Specification Sheet, Phosphate Buffered Saline[online][retrieved on Sep. 1, 2010 from: <URL:sigmaaldrich.com/catalog/DataSheetPage.do?brandKey=SIGMA&symbol=P4417] 1 page.
Stryer, L., Ed.,"Part I, molecular design of life," *Stryer Biochemistry*, W.H. Freeman and Company: NY, Third Edition, pp. 18-20 (1988).

Technical Report TR11-0248 from Blue Stream Laboratories, "C-terminal peptide mapping of PH20FL (PI-PLC) with LC-MS/MS mass spectrometry," Prepared for Halozyme, Inc., Feb. 27, 2012, 31 pages.
UniProt Murine PH20 sequence, Published on Jul. 13, 2010 [online][retrieved on Aug. 2, 2010] Retrieved from:<URL:uniprot.org/uniprot/P48794 [5 pages].
Vigdorovich et al., "Expression and characterization of a soluble, active form of the jaagsiekte sheep retrovirus receptor, Hyal2," J Virol. 79(1):79-86 (2005).
Wei et al., "Structure function analysis of the human hyaluronidase enzymes," Matrix Biology 27 (Supplement 1):S41, Dec. 2008, American Society for Matrix Biology Biennial Meeting, San Diego, CA, (available on-line Nov. 17, 2008), Abstract 132/B4, 1 page.
Wei et al., "Structure function analysis of the human hyaluronidase enzymes," American Society for Matrix Biology Biennial Meeting, San Diego, CA, Dec. 5, 2008, B4, poster, 1 page.
Notice of Opposition, submitted Aug. 10, 2010, in connection with related European Patent No. EP 1 603 541, 32 pages.
Response of Mar. 24, 2011 to Notice of Opposition, issued Aug. 10, 2010, for related European Patent No. EP 1 603 541, 42 pages.
Preliminary Opinion and Summons to attend Oral Proceedings, issued Jul. 28, 2011, in connection with related European Patent No. 1 603 541, 6 pages.
Office Action, issued Oct. 11, 2011, in connection with related U.S. Appl. No. 12/386,473, 12 pages.
Response to Office Action, issued Oct. 11, 2011, in connection with related U.S. Appl. No. 12/386,473, 19 pages.
Response to Communication Pursuant to Rules 161 and 162 EPC dated Aug. 8, 2011, in connection with related European Patent Application No. 09804345.8, 9 pages.
Withdrawal of Opposition, mailed Mar. 5, 2012, in connection with related European Patent No. 1603541, 1 page.
Response to Summons to Attend Oral Proceedings, dated Jul. 28, 2011, in connection with related European Patent No. 1 603 541, including enclosures: Main Request and Auxiliary Request Claims and Annexes A, 1-12, 471 pages.
European Patent Office Communication Pursuant to Article 101(1) and Rule 81(2) to (3) EPC, issued Apr. 5, 2012, in connection with Oral Proceedings for related European Patent No. 1603541, 3 pages.
Communication from the European Patent Office, issued Apr. 20, 2012, in connection with Opposition Proceedings associated with related European Patent No. 1 603 541 (3051EP), reporting cancellation of the Summons to Attend Oral Proceedings, 1 page.
Interlocutory Decision in Opposition Proceedings, issued May 15, 2012 in connection with related European Patent No. 1 603 541, 6 pages.
Final Office Action, issued May 24, 2012 in connection with related U.S. Appl. No. 12/386,473, 12 pages.
Examinatin Report, issued Aug. 18, 2012, in connection with Australian Patent Application No. 2009333918 (3074AU), 4 pages.
Office Action and Search Report, issued Aug. 31, 2012, in connection with corresponding Chinese Patent Application No. 200980156387.7, 9 pages.
Examination Report, issued Oct. 23, 2012, in connection with corresponding European Patent Application No. 09804345.8, 7 pages.
U.S. Appl. No. 13/694,071, filed Oct. 24, 2012.
U.S. Appl. No. 13/684,731, filed Dec. 28, 2012.
U.S. Appl. No. 13/815,311, filed Feb. 19, 2013.
U.S. Appl. No. 13/815,804, filed Mar. 15, 2013.
Letter/Written Disclosure of the Supplemental Information Disclosure Statement for the above-referenced application, mailed the same day herewith, 2 pages.
Examiner's Report, issued Mar. 26, 2013, in connection with Canadian Patent Application No. 2,746,181, 4 pages.
Response to Examination Report, issued Oct. 23, 2012, in connection with European Patent Application No. 09804345.8, 12 pages.
Frost, G. I., "Halozyme Therapeutics, Inc. Thinking outside the cell," presented at J. P. Morgan Healthcare Conference on Jan. 10, 2013. Presentation. 23 pages.
Halozyme Therapeutics Investor Presentation, "Halozyme Therapeutics, Inc.: Thinking outside the cell," Presented on Oct. 2, 2012

(56) References Cited

OTHER PUBLICATIONS

[online][retrieved on Oct. 11, 2012] Retrieved from:<URL:sec.gov/Archives/edgar/data/1159036/000119312512412748/d419091dex991.htm [82 pages].
News Release, "Halozyme Therapeutics and Pfizer enter into a collaboration to develop and commercialize subcutaneous biologics using recombinant human hyaluronidase," Published on Dec. 21, 2012 [online] [Retrieved on Jan. 3, 2013] Retrieved from:<URL:halozyme.com/Investors/News-Releases/News-Release-Details/2012/Halozyme-Therapeutics-And-Pfizer-Enter-Into-A-Collaboration-To-Develop-And-Commercialize-Subcutaneous-Biologics-Using-Recombi/default.aspx, 2 pages.
Transcript, "Halozyme Therapeutics's CEO hosts analyst/investor day conference call (Transcript)," Published on Oct. 2, 2012 [online][retrieved on Oct. 25, 2011] Retrieved from:<URL:seekingalpha.com/article/901141-halozyme-therapeutics-s-ceo-hosts-analyst-investor-day-conference-call-transcript?part=single [49 pages].
News Release, "Halozyme Therapeutics to present at the 31st Annual J.P. Morgan Healthcare Conference," Published Jan. 3, 2013 [online][Retrieved Jan. 17, 2013][ Retrieved from:<URL:halozyme.com/Investors/News-Releases/News-Release-Details/2013/Halozyme-Therapeutics-to-Present-at-the-31st-Annual-JP-Morgan-Healthcare-Conference1132508/default.aspx, 2 pages.
Response to Examination Report, issued Jul. 19, 2011, in connection with New Zealand Patent Application No. 593641, 24 pages.
Office Action and Search Report, issued Aug. 31, 2012, in connection with Chinese Patent Application No. 200980156387.7, 9 pages.
Instructions for response to Office Action, issued Aug. 31, 2012, in connection with Chinese Patent Application No. 200980156387.7, 13 pages.
Examination Report, issued Oct. 23, 2012, in connection with European Patent Application No. 09804345.8, 7 pages.
Examination Report, issued Dec. 13, 2012, in connection with New Zealand Patent Application No. 593641, 2 pages.
Response to Examination Report, issued Dec. 13, 2012, in connection with New Zealand Patent Application No. 593641, 3 pages.
Examination Report, issued Dec. 17, 2013, in connection with New Zealand Patent Application No. 604357, 2 pages.
Search Report and Written Opinion, mailed Jan. 28, 2013, in connection with Singapore Patent Application No. 201104225-6, 15 pages.
U.S. Appl. No. 13/998,040, filed Sep. 24, 2013.
U.S. Appl. No. 13/998,058, filed Sep. 25, 2013.
Letter/Written Disclosure of the Supplemental Information Disclosure Statement for the above-referenced application, mailed Oct. 18, 2013, 2 pages.
Response, dated Sep. 18, 2013, to Examination Report, issued Aug. 18, 2012, in connection with Australian Patent Application No. 2009333918, 32 pages.
Response, dated Sep. 26, 2103, to Examiner's Report, issued Mar. 26, 2013, in connection with Canadian Patent Application No. 2,746,181, 40 pages.
Office Action and Search Report, issued Jul. 2, 2012, in connection with Chinese Patent Application No. 200980156387.7 [English Translation], 2 pages.
Official Action, issued May 16, 2013, in connection with Columbian Patent Application No. 11-085406 [English translation], 3 pages.
Instructions, dated Jul. 31, 2013, for response to Official Action, issued May 16, 2013, in connection with Columbian Patent Application No. 11-085406, 19 pages.
Office Action, issued Aug. 27, 2013, in connection with Japanese Patent Application No. 2011-540704 [English Translation], 2 pages.
Office Action, issued Aug. 15, 2013, in connection with Israeli Patent Application No. 213150 [English translation], 3 pages.
Office Action, issued Sep. 30, 2013, in connection with Korean Patent Application No. 10-2011-7015830, 3 pages.
Response, dated Jun. 28, 2013, to Written Opinion, mailed Jan. 28, 2013, in connection with Singapore Patent Application No. 201104225-6, 7 pages.

Letter/Written Disclosure of the Supplemental Information Disclosure Statement for the above-referenced application, mailed Apr. 16, 2014, 2 pages.
Notification of Grant, issued Mar. 10, 2014 (received Mar. 27, 2014), in connection with corresponding Chinese Patent Application No. 200980156387.7 [English translation], 3 pages.
Search Report and Office Action, received Mar. 20, 2014, in connection with corresponding Chinese Patent Application No. 201310106164.8 [English translation], 8 pages.
Cheng et al., "Poly(ethylene glycol) modification of beta-glucuronidase-antibody conjugates for solid-tumor by targeted activation of glucuronide prodrugs," Cancer Immunology Immunother. 44(6):305-315 (1997).
Heldin, P., "Importance of hyaluronan biosynthesis and degradation in cell differentiation and tumor formation," Brazilian J. Med. Biol. Res. 36:967-973 (2003).
Hofinger et al., "Kinetics of Hyal-1 and PH-20 hyaluronidases," Glycobiology 17(9):963-971 (2007).
Sequence alignments from U.S. Appl. No. 10/795,095 search of SEQ ID No. 1 in the Issued Patents database, performed on Sep. 25, 2007. 13 pages.
Adams et al., "The c-myc oncogene driven by immunoglobulin enhancers induces lymphoid malignancy in transgenic mice," Nature 318:533-538 (1985).
Afify et al., "Purification and characterization of human serum hyaluronidases," Arch. Biochem. Biophys. 305:434-441 (1993).
Alexander, S. and J. Neander, "The use of hyaluronidase with insulin in insulin coma therapy," Psychiatr Q. 30(1):89-95 (1956).
Alexander et al., "Expression of the c-myc oncogene under control of an immunoglobulin enhancer in E mu-myc transgenic mice," Mol. Cell Biol. 7:1436-1444 (1987).
Allen et al., "Recombinant Human Hyaluronidase-Enabled Subcutaneous Pediatric Rehydration," Pediatrics 124(5):e858-e867 (2009) found at: http://pediatrics.aappublications.org/cgi/content/abstract/124/5/e858.
Altschul, S., "Basic local alignment search tool," J Mol Biol 215(3):403-410 (1990).
Angelborg et al., "The HYAL1LuCA1 Gene Is Inactivated in Breast Carcinomas by Hypermethylation/Chromatin condensation and Mediates Tumor Suppression In Vivo," Am Assoc Cancer Res 2002, 2 pages.
Ansel, H., *Introduction to Pharmaceutical Dosage Forms*, Fourth Edition, Philadelphia: Lea & Febiger, p. 126 (1985).
Anttila et al., "High levels of stromal hyaluronan predict poor disease outcome in epithelial ovarian cancer," Cancer Research 60(1):150-155 (2000).
Arming et al., "In vitro mutagenesis of PH-20 hyaluronidase from human sperm," Eur J Biochem 247(3):810-814 (1997).
Auvinen, P. "Hyaluronan in peritumoral stroma and malignant cells associates with breast cancer spreading and predicts survival," American Journal of Pathology 156(2):529-536 (2000).
Bakker et al., "Molecular cloning of two Arabidopsis UDP-galactose transporters by complementation of a deficient Chinese hamster ovary cell line," Glycobiology, 15(2):193-201 (2005).
Baumgartner et al., "Phase I study in chemoresistant loco-regional malignant disease with hyaluronidase," Reg. Cancer Treat. 1:55-58 (1988).
Baxter Health Care Corporation (R. Schiff, MD), "Gammagard Liquid and rHuPH20 in PID," retrieved from the Internet:<URL: www.clinicaltrials.gov/ct2/show/NCT00814320>, last updated Oct. 27, 2009, 5 pages.
Baxter Healthcare Corporation, "Study to determine the dose of recombinant human hyaluronidase needed to infuse a dose of IGIV subcutaneously," retrieved from the Internet:<URL: clinicaltrials.gov/ct2/show/NCT00782106>, [accessed on May 13, 2009] [3 pages].
Beckenlehner et al., "Hyaluronidase enhances the activity of adriamycin in breast cancer models in vitro and in vivo," J. Cancer Res. Oncol. 118:591-596 (1992).
Bee et al., "Recombinant human PH20 is well tolerated at higher intravenous and subcutaneous doses in cynomolgus monkeys," EUFEPS 2008, Munich, Germany, 3 pages.

(56) References Cited

OTHER PUBLICATIONS

Benhar et al., "Pseudomonas exotoxin A mutants. Replacement of surface-exposed residues in domain III with cysteine residues that can be modified with polyethylene glycol in a site-specific manner," J. Biol. Chem. 269:13398-14404 (1994).
Bernoist, C. and P. Chambon, "In vivo sequence requirements of the SV40 early promotor region," Nature 290:304-310 (1981).
Bianchi et al., "Synthetic depsipeptide substrates for the assay of human hepatitis C virus protease," Anal. Biochem. 237: 239-244 (1996).
BioWorld Today, "AACR Roundup," BioWorld Today 20(75):8 (2009).
BioWorld Today, "Clinic Roundup," BioWorld Today 20(103):8 (2009).
BioWorld Today, "Clinic Roundup," BioWorld Today 20(187):9 (2009).
BioWorld Today, "Clinic Roundup," BioWorld Today 20(190):8 (2009).
BioWorld Today, "Restructuring Roundup," BioWorld Today 20(107):3 (2009).
BioWorld Today, "Clinic Roundup," BioWorld Today 20(2):5 (2009).
BioWorld Today, "Earnings Roundup," BioWorld Today 20(205):1, 6 (2009).
Bitter et al., "Expression and secretion vectors for yeast," Methods in Enzymol 153:516-544 (1987).
Bjermer et al., "Hyaluronate and type III procollagen peptide concentrations in bronchoalveolar lavage fluid as markers of disease activity in fanner's lung," Br Med J Clin Res Ed. 295(6602):803-806 (1987).
Böhme et al., "Tyrosine sulfation and N-glycosylation of human heparin cofactor II from plasma and recombinant Chinese hamster ovary cells and their effects on heparin binding," Eur. J. Biochem. 269(3):977-988 (2002).
Bonito, A., "Effect of hyaluronidase administration on glycemic curves due to insulin in normal and diabetic subjets," Minerva Medica, Edizioni Minerva Medica, Torino, IT, vol. 45(31):, Apr. 18, 1954 pp. 1068-1073 (1954). [in the Italian language].
Bonner, W. and E. Cantey, "Colorimetric method for determination of serum hyaluronidase activity," Clin. Chim. Acta 13:746-752 (1966).
Bookbinder et al., "A Recombinant Human Enzyme for Enhanced Interstitial Transport of Therapeutics," J Control Release, 114:230-241 (2006).
Bookbinder et al., "Biochemical characterization of recombinant human PH20 (SPAM1) Hyaluronidase," Hyaluronan (ISHAS) 2007, Charleston, SC, 2 pages.
Bookbinder et al., "Enhancing drug transport through temporary matrix depolymerization," Keystone Symposia 2005, 13 pages.
Bookbinder et al., "Enhanze™ technology for antibody dispersion," Strategic Research Institute Antibody World Summit, Jul. 24-27, 2005, Jersey City, NJ, 41 pages.
Bookbinder et al., "Evaluation of the compatibility and pharmacokinetics of co-formulated biologics with recombinant human hyaluronidase: Dose Response," American Association of Pharmaceutical Scientists Conference, Nov. 2006, 3 pages.
Bordier C., "Phase separation of integral membrane proteins in Triton X-114 solution," J Biol Chem. 256(4):1604-1607 (1981).
Botzki, A., "Structure-based design of hyaluronidase inhibitors," Universitat Regensburg Munich, Germany, Dissertation, 144 pages (Mar. 2004).
Bouffard et al., "An in vitro assay for hepatitis C virus NS3 serine proteinase," Virology 209:52-59 (1995).
Braunwald, E. and P. Maroko, "Effects of hyaluronidase and hydrocortisone on myocardial necrosis after coronary occlusion," Am. J. Cardiol 37:550-556 (1976).
Brekken, C. and C. Davies, "Hyaluronidase reduces the interstitial fluid pressure in solid tumors in a non-linear concentraion-dependent manner," Cancer Letters 131:56-70 (1998).
Brinster et al., "Regulation of metallothionein-thymidine kinase fusion plasmids injected into mouse eggs," Nature 296:39-42 (1982).
Brown et al., "Cluster of diplopia cases after periocular anesthesia without hyaluronidase," J Cataract Refract Surg. 25(9):1245-1249 (1999).
Brumeanu et al., "Derivatization with monomethoxypolyethylene glycol of Igs expressing viral epitopes obviates adjuvant requirements," J Immunol. 154:3088-3095 (1995).
Burket, L. and P. Gyorgy, "Clinical observations on the use of hyaluronidase," Pediatrics 3(1):56-63 (1949).
Butters et al., "Structural characterization of the N-linked," Glycoconjugate Journal (1998) 15(1):83-88.
Byerley et al., "'Cutting out the bull'. Recombinant human hyaluronidase: Moving to an animal-free system," Association of Clinical Embryologists, 2006, Dublin, Ireland. Abstract published in Human Fertility 9(2):110 (2006).
Caliceti, P. and F. Veronese, "Pharmacokinetic and biodistribution properties of poly(ethylene glycol)-protein conjugates,"Adv. Drug Deliv. Rev. 55(10):1261-1277 (2003).
Carrillo, H. and D. Lipman, "The multiple-sequence alignment problem in biology," SIAM J Applied Math 48(5):1073-1082 (1988).
Certified English language translation of Bonito, A., "Effect of hyaluronidase administration on glycemic curves due to insulin in normal and diabetic subjets," Minerva Medica, Edizioni Minerva Medica 45(31):1068-1073 (1954).
Certified English language translation of De Sa Earp, F., "Hemiplegia secondary to cerebromeningeal hemorrhage treated with hyaluronidase with complete recovery," Arq. Braz. Med. 44:217-220 (1954).
Certified English language translation of Jost, F., "Zur Insulinempfidlichkeit der schizophrenen," Weiner Klinische Wochenschrift 70(36):657-661 (1958).
Certified English language translation of Keup, W., "Amorphes Insulin and Hyaluronidase in de Insulinbehandlung der psychosen," Schweizerische Medizinische Wochenschrift 87(35-36):1128-1131 (1957).
Certified English language translation of Reit Correa et al., "Potentialization of the action of insulin by hyaluronidase" annales d'endocrinologie 23:27 (1962).
Certified English language translation of Voyer et al., "Insulinotherapie avec alidase en plusieurs injections," L'Union Med. Canada 86:861-865 (1957).
Chapman et al., "Therapeutic antibody fragments with prolonged in vivo half-lives," Nature Biotech. 17:780-783 (1999).
Chen, W. And P. Stanley, "Five Lec 1 CHO cell mutants have distinct Mgat1 gene mutations that encode truncated N-acetylglucosaminyltransferase I," Glycobiology 13(1):43-50 (2003).
Cheng et al., "PEGylated adenoviruses for gene delivery to the intestinal epithelium by the oral route," Pharm. Res. 20(9):1444-1451 (2003).
Cherr et al., "The dual functions of GPI-anchored PH-20: hyaluronidase and intracellular signaling," Matrix Biol., 20:515-525, 2001.
Cherr et al., "The PH-20 protein in cynomolgus macaque spermatozoa: identification of two different forms exhibiting hyaluronidase activity," Dev. Biol., 175:142-153, 1996.
Cho et al., "Construction of hepatitis C-SIN virus recombinants with replicative dependency on hepatitis C virus serine protease activity," J. Virol. Meth. (65):201-207 (1997).
ClinicalTrials.gov, "Pharmacokinetic, safety and tolerability study of SC administered bisphosphonate With rHuPH20 vs bisphosphonate alone," retrieved from the Internet:<URL: clinicaltrials.govict2/show/NCT00807963>, last updated Jun. 3, 2009 [accessed on Nov. 25, 2009] [4 pages].
Colbere-Garapin et al., "A new dominant hybrid selective marker for higher eukaryotic cells," J Mol Biol 150:1-14 (1981).
Conserved domain search from U.S. Appl. No. 10/795,095 of SEQ ID No. 6, Primakoff et al. US 5,721,348, performed on the NCBI website on Aug. 5, 2008. 1 page.
Csoka et al., "Hyaluronidases in tissue invasion," Invasion Metastasis 17:297-311 (1997).
Csoka et al., "Purification and microsequencing of hyaluronidase isozymes from human urine," FEBS Lett., 417(3):307-310 (1997).

(56) References Cited

OTHER PUBLICATIONS

Csoka et al., "The six hyaluronidase-like genes in the human and mouse genomes," Matrix Biol. 20:499-508 (2001).
Czejka et al., "Influence of hyaluronidase on the blood plasma levels of 5-fluorouracil in patients," Pharmazie 45:H.9 (1990).
De Giovanni et al., "Trial of glycosamino glycan lyase (G L enzyme) in acute myocardial infarction," Br Heart J. 45:350 (1981).
De Maeyer, E. and J. De Maeyer, "The growth rate of two transplantable murine tumors, 3LL lung carcinoma and B16F10 melanoma, is influenced by Hyal-1, a locus determining hyaluronidase levels and polymorphism," Int. J. Cancer 51:657-660 (1992).
de Oliveria et al., "Intravenous injection of Hyaluronidase in acute myocardial infarction: Preliminary report of clinical and experimental observations," American Heart Journal 57(5):712-722 (1959).
De Sa Earp, F., "Hemiplegia secondary to cerebromeningeal hemorrhage treated with hyaluronidase with complete recovery,"Arq. Braz. Med. 44:217-220 (1954) [in the Portugese language].
De Salegui et al., "A Comparison of Serum and Testicular Hyaluronidase," Arch. Biochem. Biophys. 121:548-554 (1967).
Deboer et al., "The tac promoter: a functional hybrid derived from the trp and lac promoters," Proc. Natl. Acad. Sci. USA 80:21-25.(1983).
Delpech et al., "Enzyme-linked hyaluronectin: a unique reagent for hyaluronan assay and tissue location and for hyaluronidase activity detection," Anal. Biochem. 229:35-41 (1995).
Derwent Abstract for WO 1988002261. Inventor: Baumgartne et al., WPI Acc No. 1988 105412/198815, Dialog File No. 351. Abstract published 1988 [2 pages].
Devereux, J., et al, "A comprehensive set of sequence analysis programs for the VAX," Nucleic Acids Research 12:387-395 (1984).
Dorfman, A. and M. Ott, "A turbidimetric method for the assay of hyaluronidase," J. Biol. Chem. 172:367-375 (1948).
Drug Shortage Bulletin: Hyaluronidase Injection—Discontinued, published Jan. 18, 2005, American Society of Health-System Pharmacist, retrieved from the Internet:<URL: ashp.org/shortage/hyaluronidase.cfm?cfid=11944667&CFToken=9426953%2>, last accessed Mar. 21, 2006. (3 pages).
Drugs R&D, "Hyaluronidase (Vitrase®)—ISTA," 4(3):194-197 (2003).
D'Souza et al., "In vitro cleavage of hepatitis C virus polyprotein substrates by purified recombinant NS3 protease," J. Gen. Virol. 76:1729-1736 (1995).
Dubensky et al., "Direct transfection of viral and plasmid DNA into the liver or spleen of mice," Proc Natl Acad Sci U S A 81(23):7529-7533 (1984).
Eckhardt et al., "Mutants of the CMP-sialic acid transporter causing the Lec2 phenotype," J. Biol. Chem. 273:20189-20195 (1998).
Eisenhaber et al., "Prediction of potential GPI-modification sites in proprotein sequences," J. Mol. Biol. 292(3):741-758 (1999).
Elbein et al., "Kifunensine inhibits glycoprotein processing and the function of the modified LDL receptor in endothelial cells," Archives of Biochem and Biophy 288(1):177-184 (1991).
Elbein et al., "Kifunensine, a potent inhibitor of the glycoprotein processing Mannosidase I," J Biol Chem 265(26):15599-15605 (1990).
Elder et. al, "Intra-arterial hyaluronidase in severe peripheral arterial disease," Lancet 648-649 (1980).
Evison et al., "Improvement in ICSI Survival and Fertilisation rates with the use of cumulase, recombinant hyaluronidase (Rochford Medical)," 5th Biennial Joint Meeting of the UK Fertility Societies Association of Clinical Embryologists, British Fertility Society, Society for Reproduction & Fertility, Apr. 2007, York, England, Abstract p. 22, 1 page.
Fankhauser, N. and P. Maser, "Identification of GPI anchor attachment signals by a Kohonen self-organizing map," Bioinformatics 21(9) 1846-1852 (2005).
Favre et al., "Hyaluronidase enhances recombinant adeno-associated virus (rAAV)-mediated gene transfer in the rat skeletal muscle," Gene Ther 7(16):1417-1420 (2000).
Federal Register, Sep. 23, 1970 (35 FR 14800); Wydase NDA 6-343, (40 pages).

Felix et al., "Pegylated peptides. IV. Enhanced biological activity of site-directed pegylated GRF analogs," Int. J. Peptide Res. 46:253-264 (1995).
Few, B., "Hyaluronidase for treating intravenous extravasations," Amer. J. Matern. Child Nurs. 12:23 (1987).
Filocamo et al., "Chimeric Sindbis viruses dependent on the NS3 protease of hepatitis C virus," J.Virology 71(2):1417-1427 (1997).
Fiszer-Szafarz et al., "Human hyaluronidases: electrophoretic multiple forms in somatic tissues and body fluids evidence for conserved hyaluronidase potential N-glycosylation sites in different mammalian species," J. Biochem. Biophys. Methods 45:103-116 2000.
Form 10-Q for Halozyme Therapeutics dated May 8, 2009, retrieved from the Internet:<URL: biz.yahoo.com/e/090508/halo10-q.html>. [retrieved on Nov. 25, 2009] [6 pages].
Fox et al., "Method of preventing insulin atrophy," Br Med Journal 2(4847):1202-1203 (1953).
Frost et al., "HYAL1LUCA-1, a candidate tumor suppressor gene on chromosome 3p21.3, is inactivated in head and neck squamous cell carcinomas by aberrant splicing of pre-mRNA," Oncogene 19:870-877 (2000).
Frost et al., "Punctuated Equilibrium: The Evolution of Recombinant Human Hyaluronidase," Ophthalmic Anesthesia Society, 2006, Chicago, IL, 36 pages.
Frost et al., "Purification, cloning, and expression of human plasma hyaluronidase," Biochem. Biophys. Res. Commun. 236:10-15 (1997).
Frost et al., "Subcutaneous Strategies for Monoclonal Antibody Delivery," Drug Delivery 2007: Where Science and Business Meet, 2007, San Diego, CA, 1 page.
Frost, G. and R. Stern, "A microtiter-based assay for hyaluronidase activity not requiring specialized reagents,"Anal. Biochem. 251:263-269 (1997).
Frost, G., "Recombinant human hyaluronidase (rHuPH20): an enabling platform for subcutaneous drug and fluid administration," Expert Opin. Drug. Deliv. 4:427-440 (2007).
Gacesa et al., "Effect of ionic strength and serum on the activity profile of bovine testicular hyaluronidase [proceedings]," Biochem. Soc. Trans. 7:1287-1289 (1979).
Gardner et al., "The complete nucleotide sequence of an infectious clone of cauliflower mosaic virus by M13mp7 shotgun sequencing," Nucleic Acids Res. 9:2871-2888 (1981).
Genbank Accession No. BCO21102 "*Homo sapiens* zinc finger CCCH-type containing 15, mRNA (cDNA clone)," retrieved from the Internet:<URL: www.ncbi.nlm.nih.gov/entrez/viewer.fcgi?db=nucleotide&val=18088891>. Accession No. BC021102, Published on Dec. 2, 2006. [accessed May 1, 2008] [4 pages].
Genbank Accession No. NP-003108 "*Homo sapiens* Sperm Adhesion Molecule 1 Isoform 1," retrieved from the Internet:<URL: ncbi.nlm.nih.gov/entrez/viewer.fcgi?db=protein&val=21314606, [accessed May 1, 2008] [5 pages].
Gilbert, W. and L. Villa-Komaroff, "Useful Proteins from Recombinant Bacteria," Scientific American 242(4):74-94 (1980).
Gmachl et al., "The human sperm protein PH-20 has hyaluronidase activity," FEBS 336(3):545-548 (1993).
Gottleib et al., "The safety of intravitreal hyaluronidase. A clinical and histologic study," Invest Ophthalmol Vis Sci 31:(11)2345-2352 (1990).
Greenbaum, S., "Early experience with hylenex-assisted parabulbar anesthesia," Annual Meeting of the Ophthalmic Anesthesia Society in Chicago, IL., Sep. 2007, 2 pages.
Gribskov et al., "Sigma factors from *E. coli*, *B. subtilis*, phage SP01, and phage T4 are homologous proteins," Nucl. Acids Res. 14:6745-6763 (1986).
Grosschedl et al., "Introduction of a mu immunoglobulin gene into the mouse germ line: specific expression in lymphoid cells and synthesis of functional antibody," Cell 38:647-658 (1984).
Guiotto et al., "An improved procedure for the synthesis of branched polyethylene glycols (PEGs) with the reporter dipeptide Met-betaAla for protein conjugation," Bioorg. Med. Chem. Lett. 12:177-180 (2002).
Guo et al., "Protein tolerance to random amino acid change," Proc. Nat'l. Acad. Sci. USA 101:9205-9210 (2004).

(56) References Cited

OTHER PUBLICATIONS

Gysin, W. and J. Wilson, "Hyaluronidase in insulin coma therapy," Diseases of the Nervous System 15(5):138-141 (1953).
Haberman et al., Proceedings of the 17th Annual Meeting of the American Society of Clinical Oncology, Washington, D.C., 22:105, abstract No. 415 (1981).
Hahm et al., "Generation of a novel poliovirus with a requirement of hepatitis C virus protease NS3 activity," Virology 226:318-326 (1996).
Haller et al., "Enhanze technology—a revolution in drug dispersion," Biotechnology Industry Organization (BIO) Annual Meeting, 2005, Philadelphia, PA, 4 pages.
Haller et al., "Escaping the interstitial matrix with enzyme-mediated drug delivery," Drug Delivery Technology 5(5):1-6 (2005).
Haller et al., "Recombinant human hyaluronidase for the interstitial transport of therapeutics," American Association of Pharmaceutical Scientists Conference, Jun. 2006, San Antonio, TX, 2 pages.
Haller et al., "The effects of recombinant human hyaluronidase on drug dispersion," American Association of Pharmaceutical Scientists Annual Meeting, 2005, Nashville, TN, 3 pages.
Haller, M., "Converting intravenous dosing to subcutaneous dosing with recombinant human hyaluronidase," Pharmaceut Tech. Newsletter, Oct. 2007, 14 pgs.
Haller, M., "Enhanze technology—an enzymatic drug delivery system (DDS)," Japanese Export Trade Organization, 2005, Santa Clara, CA, 2 pages.
Haller, M., "Focus on Enhanced and Innovative Recombinant Human Enzymes," Japanese Export Trade Organization, Sep. 2004, Chicago, IL, 16 pages.
Haller, M., "Halozyme's Enhanze Technology for the Enhanced Dispersion of Co-Injected Pharmaceuticals," Japanese Export Trade Organization, Sep. 2004, Chicago, IL, 2 pages.
Hallgren et al, "Accumulation of hyaluronan (hyaluronic acid) in myocardial interstitial tissue parallels development of transplantation edema in heart allografts in rats," J Clin Invest 85:668-673 (1990).
Hallgren et al, "Hyaluronic acid accumulation and redistribution in rejecting rat kidney graft. Relationship to the transplantation edema," J Exp Med. 171:2063-2076 (1990).
Hallgren et al., "Accumulation of hyaluronan (hyaluronic acid) in the lung in adult respiratory distress syndrome," Am Rev Respzr Dis. 139(3):682-687 (1989).
Halozyme Therapeutics Investor Presentation, "Company Overview," May 15, 2008. (15 pages).
Halozyme Therapeutics Investor Presentation, "Company Overview," Feb. 12, 2008. (37 pages).
Halozyme Therapeutics Investor Presentation, "Company Overview," Feb. 22, 2007. (25 pages).
Halozyme Therapeutics Investor Presentation, "Company Overview," Jun. 28, 2006. (28 pages).
Halozyme Therapeutics Investor Presentation, "Company Overview," Feb. 1, 2006, (34 pages).
Halozyme Therapeutics Investor Presentation, "Company Overview," Nov. 29, 2005. (34 pages).
Halozyme Therapeutics Investor Presentation, "Focus on enhanced and innovative recombinant human enzymes," Jan. 28, 2005. (28 pages).
Halozyme Therapeutics Investor Presentation, "Focus on enhanced and innovative recombinant human enzymes," Mar. 12, 2004. (32 pages).
Halozyme Therapeutics, Analyst and Investor Meeting presentations including by Lim, J., "Introduction and strategic review," Little, R., "Leveraging the technology across multiple partners," Frost, G., "Discovery and early development pipeline update," and D. Muchmore, "Ultrafast insulinPH20 program—where we are going," Presented Oct. 15, 2009 in New York. (88 pages).
Hamatake et al., "Establishment of an in vitro assay to characterize hepatitis C virus NS3-4A protease trans-processing activity ," Intervirology 39:249-258 (1996).

Hammer et al., "Diversity of alpha-fetoprotein gene expression in mice is generated by a combination of separate enhancer elements," Science 235:53-58 (1987).
Hanahan, D., "Heritable formation of pancreatic beta-cell tumours in transgenic mice expressing recombinant insulin/simian virus 40 oncogenes," Nature (3)15:115-122 (1985).
Harris, J. and R. Chess, "The effect of pegylation on pharmaceuticals," Nature Reviews 2:214-221 (2003).
Harrison, R. and D. Jarvis, "Protein N-Glycosylation in the Baculovirus-insect Cell Expression System and Engineering of insect cells to produce mammalianized recombinant Glycoproteins," Advances in Virus Research 68:159-191 (2006).
Hartman S. and R. Mulligan, "Two dominant-acting selectable markers for gene transfer studies in mammalian cells," Proc Natl Acad Sci 85:8047-8051 (1988).
Herrera-Estrella et al., "Expression of chimaeric genes transferred into plant cells using a ti-plasmid-derived vector,"Nature 303:209-213 (1984).
Herrera-Estrella et al., "Light-inducible and chloroplast-associated expression of a chimaeric gene introduced into Nicotiana tabacum using a Ti plasmid vector," Nature 310(5973):115-120 (1984).
Hofer et al., "Human Recombinant Hyaluronidase Increases the Convection of Molecules up to 0.2 μm in Athymic Nude Mice," J. Am. Assoc. Lab. Animal Sci., 45:120 abstract p. 97 (2006). 2 pages.
Hofinger et al., "Isoenzyme-specific differences in the degradation of hyaluronic acid by mammalian-type hyaluronidases," Glycoconj J 25:101-109 (2008).
Hofinger et al., "Recombinant human hyaluronidase Hyal-1: insect cells versus *Escherichia coli* as expression system and identification of low molecular weight inhibitors," Glycobiology 17(4):444-453 (2007).
Holden, J. and O. McGuinness, "Use of Hyaluronidase in insulin coma therapy," British Medical Journal 2(5036):85-86 (1957).
Hompesch et al., "Accelerated Insulin Pharmacokinetics and Improved Glycemic Control in T1DM Patients by Coadministration of Prandial Insulin with Recombinant Human Hyaluronidase," American Diabetes Association, Jun. 6, 2009, New Orleans, 2 pages.
Horn et al., "Intravesical chemotherapy of superficial bladder tumors in a controlled trial with cis-platinum versus cis-platinum plus hyaluronidase," J. Surg. Oncol. 28:304-307 (1985).
Hunnicut et al., "Structural relationship of sperm soluble hyaluronidase to the sperm membrane protein PH-20," Biol Reprod. 54(6):1343-1349 (1996).
Ito et al., "Cultivation of hepatitis C virus in primary hepatocyte culture from patients with chronic hepatitis C results in release of high titre infectious virus," J. Gen. Virol. 77:1043-1054 (1996).
IUPAC-IUB Commission on Biochemical Nomenclature, "A One-Letter Notation for Amino Acid Sequences: Tentative Rules," J. Biol. Chem. 243:3557-3559 (1968).
IUPAC-IUB Commission on Biochemical Nomenclature, "Abbreviated nomenclature of synthetic poypeptides-polymerized amino acids-revised recommendations," Biochemistry 11:1726-1731 (1972).
Jay et al., "Construction of a general vector for efficient expression of mammalian proteins in bacteria: use of a synthetic ribosome binding site," Proc. Natl. Acad. Sci. USA 78(9):5543-5548 (1981).
Jiang et al., "PEGPH20: PEGylated recombinant human hyaluronidase antitumor activity in the 4T1 orthotopic breast carcinoma model," Proceedings of the American Association for Cancer Research Annual Meeting, vol. 50, Apr. 2009, p. 65, XP001525053 & 100th Annual Meeting of the American-Association-For-Cancer-Research; Denver, Co., USA; Apr. 18-22, 2009. ISSN: 0197-016X, abstract. 2 pages.
Jiang et al., "Effects of Recombinant Human PH20 (rHuPH20) on Interstitial Matrices: Creating a Favorable Environment for the Delivery of Cytostatic Agents," American Association for Cancer Research Annual Meeting, 2005, Anaheim, CA, vol. 46, Apr. 2005, p. 1198, XP001525054.
Jiang et al., "Reduction of ischemic stroke mortality with chronic intravenous recombinant human hyaluronidase (rHuPH20): effects of pharmacokinetic optimization," American Neurological Association Annual Meeting, 2005, San Diego, CA, 7 pages.

(56) References Cited

OTHER PUBLICATIONS

Jiang et al., "Safety and activity of rHuPH20 hyaluronidase co-administration with mitomycin in the treatment of superficial transitional bladder carcinoma," American Association for Cancer Research Annual Meeting, 2006, Washington, DC, 06-LBA-8826-AACR., 3 pages.
Jiang et al., "Subcutaneous co-administration of a potent bisphosphonate with recombinant human hyaluronidase (rHuPH20) inhibits injection site reactions with systemic bioavailability comparable to intravenous bisphosphonate administration in preclinical animal models," American Association for Cancer Research Annual Meeting, 2008, San Diego, CA, 2 pages.
Johnsson et al., "Hyaluronidase ameliorates rejection-induced edema," Transplant Int 12:235-243 (1999).
Johnsson et al., "Hyaluronidase can be used to reduce interstitial edema in the prescence of heparin," Journal of Cardiovascular Pharmacology and Therapeutics 5(3):229-236 (2000).
Jost, F., "Zur Insulinempfidlichkeit der schizophrenen," Weiner Klinische Wochenschrift 70(36):657-661 (1958). [in the German language].
Kadhim et al., " PEGPH20: PEGylated Human Recombinant PH20 Hyaluronidase Shows Significant Antitumor Activity Concomitant with Hyaluronan Reduction in the PC3 Hormone Refractory Prostate Caner Model," Poster #8569, AACR 2009, 1 page.
Kadhim et al., "Antitumor Activity of Pegylated Recombinant Human Hyaluronidase (PEGPH20) in Xenograft and Syngeneic Rat MatLyLu Prostate Carcinoma Models," 100th Annual Meeting of the American-Association-For-Cancer-Research; Denver, Co., USA; Apr. 18-22, 2009, vol. 50, Apr. 2009, p. 65, XP001525053,. 2 pages.
Kadhim et al., "Synergistic anti-tumor effect of pegylated recombinant human hyaluronidase (PEGrHuPH20) with cytotoxic agents following intravenous administration in a hormone refractory prostate cancer xenograft model," American Association for Cancer Research (AACR) Translational Cancer Medicine Meeting, Monterey, CA, Jul. 21, 2008, A45. 2 pages.
Kang et al., "Use of a recombinant human enzyme for enhanced local adenovirus mediated gene delivery," American Association of Pharmaceutical Scientists Annual Meeting, 2005, Nashville, TN, 2 pages.
Karvinen et al., "Hyaluronan, CD44 and versican in epidermal keratinocyte tumors," British Journal of Dermatology 148:86-94 (2003).
Keller et al., "Pharmacokinetic, pharmacodynamic and toxicologic effects of a recombinant human hyaluronidase (rHuPH20) in rodent and non-human primate models," Hyaluronan (ISHAS) 2007, Charleston, SC, 2 pages.
Kelsey et al., "Species- and tissue-specific expression of human alpha 1-antitrypsin in transgenic mice," Genes and Devel. 1:161-171 (1987).
Keup, W., "Amorphes Insulin and Hyaluronidase in de Insulinbehandlung der psychosen," Schweizerische Medizinische Wochenschrift 87(35-36):1128-1131 (1957). [in the German language].
Kloner et al., "Effect of hyaluronidase during the early phase of acute myocardial ischemia: an ultrastructural and morphometric analysis," Am J Cardiol. 40(1):43-49 (1977).
Kodandapani et al., "Diverse Structural and Functional Roles of N-glycosylations on rHuPH20" Glycan Abstract, 1 page (2009).
Kohno et al., "Effects of hyaluronidase on doxorubicin penetration into squamous carcinoma multicellular tumor spheroids and its cell lethality," J. Cancer Res. Oncol. 120:293-297 (1994).
Kollias et al., "Regulated expression of human A gamma-, beta-, and hybrid gamma beta-globin genes in transgenic mice: manipulation of the developmental expression patterns," Cell 46:89-94 (1986).
Kolodgie et al, "Differential accumulation of proteoglycans and hyaluronan in culprit lesions: insights into plaque erosion," Arterioscler Thromb Vasc Biol. 22(10):1642-1648 (2002).
Koven et al., "Correction by hyaluronidase of the interstitial tissue transport defect during shock: a new approach to therapy," J Trauma 15(11):992-998 (1975).

Kozak et al., "Recombinant human hyaluronidase facilitates dexamethasone penetration into the posterior ocular segment after sub-tenon's injection," Association for Research in Vision and Ophthalmology Annual Meeting, 2005, Fort Lauderdale, FL, 3 pages.
Kozak et al., "The effect of recombinant human hyaluronidase on dexamethasone penetration into the posterior segment of the eye after sub-tenon's injection," Journal of Ocular Pharmacology and Therapeutics 22(5):362-369 (2006).
Kriel, K., "Hyaluronidases—a group of neglected enzymes," Protein Sci. 4(9):1666-1669 (1995).
Krumlauf et al., Developmental regulation of alpha-fetoprotein genes in transgenic mice, Mol. Cell. Biol. 5:1639-1648 (1985).
Kundu et al., "Dispersion of the cumulus matrix with a highly purified recombinant human hyaluronidase (rHuPH20)," Hyaluronan Meeting, 2003, Cleveland, OH., 2 pages.
Lalancette et al, "Characterization of an 80-kilodalton bull sperm protein identified as PH-20," Biol Reprod. 65(2):628-636 (2001).
Lathrop et al., "cDNA cloning reveals the molecular structure of a sperm surface protein, PH-20, involved in sperm-egg adhesion and the wide distribution of its gene among mammals," J Cell Biol. 111(6 Pt 2):2939-2949 (1990).
Laurent et al, "Hyaluronan in human cerebrospinal fluid," Acta Neurol Scand 94(3):194-206 (1996).
Laurent, T. and J. Fraser, "Hyaluronan," FASEB J 6:2397-2404 (1992).
Leder et al., "Consequences of widespread deregulation of the c-myc gene in transgenic mice: multiple neoplasms and normal development," Cell 45:485-495 (1986).
Lee et al., "Chinese hamster ovary (CHO) cells may express six beta 4-galactosyltransferases (beta 4GalTs). Consequences of the loss of functional beta 4GalT-1, beta 4GalT-6, or both in CHO glycosylation mutants," J. Biol. Chem. 276(17):13924-13934 (2001).
Leesch et al., "30-Day Pharmacokinetic Evaluation of IV versus Subcutaneous Administration of Immunoglobulin with and without Recombinant Human Hyaluronidase in Dogs," Journal of Allergy and Clinical Immunology 123(2 Suppl. S): p. s1O (2009) and 65th Annual Meeting of the American Academy of Allergy Asthma and Immunology; Washington DC, Mar. 13-17, 2009.
Li et al, "PEGylated human recombinant hyaluronidase (PEGPH20) removes peritumoral hyaluronan and increases the efficacy of chemotherapy and radiotherapy in an experimental brain metastisis model" Poster 2009 ASCR Apr. 13 2009. 1 page.
Lin et al., "A hyaluronidase activity of the sperm plasma membrane protein PH-20 enables sperm to penetrate the cumulus cell layer surrounding the egg," J Cell Biol. 125(5):1157-1163 (1994).
Lin et al., "Molecular cloning of the human and monkey sperm surface protein PH-20," Proc. Natl. Acad. Sci. USA 90:10071-10075 (1993).
Lipponen et al "High stromal hyaluronan level is associated with poor differentiation and metastasis in prostate cancer" European Journal of Cancer 37 (2001) 849-856.
Lowy et al., "Isolation of transforming DNA: cloning the hamster aprt gene," Cell 22:817-823 (1980).
Lu, H. and E. Wimmer., "Poliovirus chimeras replicating under the translational control of genetic elements of hepatitis C virus reveal unusual properties of the internal ribosomal entry site of hepatitis C virus," Proc. Natl. Acad. Sci. USA 93:1412-1417 (1996).
Lu, Y. and A. Felix, "Pegylated peptides I: Solid-phase synthesis of N alpha-pegylated peptides using Fmoc strategy," Peptide Res 6:140-146 (1993).
Lu, Y. and A. Felix, "Pegylated peptides. II. Solid-phase synthesis of amino-, carboxy- and side-chain pegylated peptides," Int. J. Peptide Protein Res. 43:127-138 (1994).
Ma et al., "Fucosylation in prokaryotes and eukaryotes" Glycobiology 16 (12) 158R-184R (2006).
Macdonald, R., "Expression of the pancreatic elastase I gene in transgenic mice," Hepatology 7:42S-51S (1987).
Maclean et al., "Long-term preservation of ischemic myocardium after experimental coronary artery occlusion," J Clin. Invest. 61:541-551 (1978).
Maclean, et. al., "Hyaluronidase-induced reductions in myocardial infarct size," Science 194(4261):199-200 (1976).

(56) References Cited

OTHER PUBLICATIONS

Magram et al., "Developmental regulation of a cloned adult beta-globin gene in transgenic mice," Nature 315:338-340 (1985).
Mammalian Gene Collection (MGC) Program Team, "Generation and initial analysis of more than 15,000 full-length human and mouse cDNA sequences," Proc. Natl. Acad. Sci. USA 99:16899-16903 (2002).
Mantovani et al., "Efficacy of varying concentrations of hyaluronidase in peribulbar anaesthesia," British J. Anaesthesia 86:876-878 (2001).
Maroko et al., "Effects of hyaluronidase administration on myocardial ischemic injury in acute infarction," Ann. Intern Med. 82:516-520 (1975).
Maroko et al., "Favorable effects of hyaluronidase on electrocardiographic evidence of necrosis in patients with acute myocardial infarction," N. Engl. J. Med. 296:898-903 (1977).
Maroko et al., "Reduction by hyaluronidase of myocardial necrosis following coronary occlusion," Circulation 46:430-437 (1972).
Mason et al., "The hypogonadal mouse: reproductive functions restored by gene therapy," Science 234:1372-1378 (1986).
Mehvar et al., "Modulation of the pharmacokinetics and pharmacodynamics of proteins by polyethylene glycol conjugation," J. Pharm. Pharmaceut. Sci. 3(1):125-136 (2000).
Melamed et al., "Recombinant human hyaluronidase facilitates dispersion of subcutaneously administered gammagard liquid and enables administration of a full monthly dose in a single site to patients with immunodeficiency diseases," Am Acad Allergy Asthma Immunol 2008 Philadelphia, PA, 5 pages.
Menzel, E. and C. Farr, "Hyaluronidase and its substrate hyaluronan: biochemistry, biological activities and therapeutic uses," Cancer Lett., 131:3-11 (2003).
Merrifield, R., "Solid phase peptide synthesis. I. The synthesis of a tetrapeptide," J Am Chem Soc 85:2149-2154 (1963).
Miura et al., "Analysis of glycosaminoglycan-degrading enzymes by substrate gel electrophoresis (zymography)," Anal. Biochem. 225:333-340 (1995).
Mizutani et al., Characterization of hepatitis C virus replication in cloned cells obtained from a human T-cell leukemia virus type 1-infected cell line, MT-2, J.Virol. 70:7219-7223 (1996).
Mizutani et al., "Inhibition of hepatitis C virus replication by antisense oligonucleotide in culture cells," Biochem. Biophys. Res. Commun. 212:906-911 (1995).
Mizutani et al., "Long-term human T-cell culture system supporting hepatitis C virus replication," Biochem. Biophys. Res. Commun. 227:822-826 (1996).
Modena et al., "Hyaluronidase-injectable microparticles intended for the treatment of extravasation," J. Microencapsulation, 15(1):85-92 (1998).
Molineux, G., "Pegylation: engineering improved biopharmaceuticals for oncology," Pharmacotherapy 23 (8 Pt 2):3S-8S (2003).
Monfardini et al, "A branched monomethoxypoly(ethylene glycol) for protein modification," Bioconjugate Chem. 6: 62-69 (1995).
Nadjsombati et al., "Evaluation of Developmental and Prenatal/Postnatal Reproduction Toxixity of rHuPH2O in Mice" American College of Toxicology 30th annual meeting 2009. Abstract (Nov. 1-4) Palm Springs, CA. 1 page.
Nagy et al., "Prospective, randomized study on bovine and recombinant human (Cumulase®) Hyaluronidases," American Society of Reproductive Medicine, 2006, New Orleans, LA, 06-A-886-ASRM. 2 pages.
Nakayama et al., "CD15 expression in mature granulocytes is determined by alpha 1,3-fucosyltransferase IX, but in promyelocytes and monocytes by alpha 1,3-fucosyltransferase IV," J. Biol. Chem., 276(19):16100-16106 (2001).
Needleman, S. and C. Wunsch "A general method applicable to the search for similarities in the amino acid sequence of two proteins," J Mol Biol. 48:443-453 (1970).

Nettelbladt et al, "Accumulation of hyaluronic acid in the alveolar interstitial tissue in bleomycin-induced alveolitis," Am Rev Resp Dis 139:759-762 (1989).
News release, "Halozyme Studies Target Hyaluronan Surrounding Solid tumors, May offer new approach to cancer treatment," retrieved from the Internet:<URL: medicalnewstoday.com/articles/146915. php>, published Apr. 22, 2009, [2 pages] [accessed Feb. 11, 2010].
News release "Halozyme Therapeutics Presents Positive Pre-Clinical Single Agent Data for PEGPH20," Jan. 26, 2009, 2 pages.
News Release, "Baxter introduces HYLENEX for use in ophthalmic surgery," retrieved from the Internet:<URL: baxter.com/about__baxter/news__room/news__releases/2007/04-27-07-hylenex.html>, published Apr. 27, 2007, [2 pages] [accessed Jun. 23, 2009].
News Release, "Halozyme Therapeutics Announces Positive Findings with Pegylated Enzyme in Prostate Cancer Models," retrieved from the Internet:<URL: www.clinicaltrials.govict2/show/NCT00814320>, last updated Oct. 27, 2009, 5 pages. [accessed Nov. 6, 2009] [5 pages].
News Release, "Halozyme Therapeutics Presents Findings on Combinations of rHuPH20 Enzyme with Bisphosphonates at the American Association for Cancer Research Conference" Apr. 14, 2008 [2 pages].
News Release, "Halozyme Therapeutics Presents Pre-Clinical Studies with Systemic Delivery of Pegylated rHuPH20 Enzyme in Prostate Cancer Models at American Association for Cancer Research" Apr. 15, 2008 [3 pages].
News Release, Halozyme Therapeutics Inc. Q3 2008 Earnings Call Transcript retrieved from the Internet:<URL: seelcingalpha.com/article/106797-halozyme-therapeutics-inc-q3-2008-earnings-call-transcript?page=-1>, [accessed on Nov. 6, 2009] [9 pages].
News Release, Halozyme Therapeutics Inc. Q3 2009 Earnings Call Transcript retrieved from the Internet:<URL: seekingalpha.com/article/171883-halozyme-therapeuties-inc-q3-2009-earnings-call-transcript?page=-1>, [accessed on Nov. 6, 2009] [11 pages].
News Release, Halozyme Therapeutics Inc. Q4 2007 Earnings Call Transcript retrieved from the Internet:<URL: seekingalpha.com/article/68609-halozyme-therapeutics-q4-2007-earnings-call-transcript>, [accessed on Jun. 24, 2009] [12 pages].
News Release, Halozyme Therapeutics Inc., "Halozyme study results demonstrate significantly less absorption variability for insulin Lispro administered with PH20 enzyme," retrieved from the Internet:<URL: www.earthtimes.org/articles/show/halozyme-study-results-demonstrate-significantly1033422.shtml>, [retrieved on Dec. 16, 2009] [3 pages]. Published Nov. 7, 2009.
News Release, Halozyme Therapeutics Inc., "Baxter Presents Latest Clinical Trial Results of Gammagard Liquid Administered Subcutaneously," Philadelphia, PA, Mar. 16, 2008, retrieved from the Internet:<URL: phx.corporate-innet/phoenix.zhtml?c=175436&p=irol-newsArticle__Print&ID=1120341&highlight=>, (accessed Jan. 6, 2009), 4 pages.
News Release, Halozyme Therapeutics Inc., "Halozyme and Baxter Announce Availability of Hylenex for Subcutaneous Delivery of Medications and Fluids," San Diego, CA, Jun. 27, 2006, retrieved from the Internet:<URL: /phx.corporate-ir.net/phoenix.zhtml?c=175436&p=irol-newsArticle__Print&ID=876530&highlight=>, (accessed Jan. 6, 2009), 3 pages.
News Release, Halozyme Therapeutics Inc., "Halozyme Therapeutics Begins Phase 1 Clinical Trial of Bisphosphonate Administered With rHuPH20 Enzyme," San Diego, CA, Dec. 10, 2008, retrieved from the Internet:<URL: phx.corporate-ir.net/phoenix.zhtml?c=175436&p=irolnewsArticle__Print&ID=1234643&highlight=>. (accessed Jan. 6, 2009), 2 pages.
News Release, Halozyme Therapeutics Inc., "Halozyme Therapeutics Announces Roche Begins Phase 1 Clinical Trial and Selects Fourth Exclusive Biologic Target," San Diego, CA, Dec. 8, 2008, retrieved from the Internet:<URL: phx.corporate-ir.net/phoenix.zhtml?c=175436&p=irol-newsArticle__Print&ID=1233454&highlight=>. (accessed Jan. 6, 2009), 2 pages.
News Release, Halozyme Therapeutics Inc., "Halozyme Therapeutics Begins Phase 2 Clinical Trial of Insulin With rHuPH20 in Type 1 Diabetic Patients," San Diego, CA, Nov. 3, 2008, retrieved from the

(56) References Cited

OTHER PUBLICATIONS

Internet:<URL: phx.corporate-ir.net/phoenix.zhtml?c=175436&p=irol-newsArticle_Print&ID=1220870&highlight=>. (accessed Jan. 6, 2009), 2 pages.

News Release, Halozyme Therapeutics Inc., "Halozyme Therapeutics Announces That Chemophase Meets Primary Endpoint in Phase I/IIa Clinical Trial," San Diego, CA, Jun. 30, 2008, retrieved from the Internet:<URL: phx.corporate-ir.net/phoenix.zhtml?c=175436&p=irol-newsArticle_Print&ID=1170737&highlight=>. (accessed Jan. 6, 2009), 3 pages.

News Release, Halozyme Therapeutics Inc., "Halozyme Therapeutics Announces Phase 1 Clinical Trial Results Demonstrating that the Combination of Recombinant Human Hyaluronidase (rHuPH20) With Humulin R(R) and with Humalog(R) Yields Faster, More Physiologic Insulin Kinetics and Better Predictability," San Francisco, CA, Jun. 9, 2008, retrieved from the Internet:<URL: phx.corporate-ir.net/phoenix.zhtml?c=175436&p=irol-newsArticle_Print&ID=1163612&highlight=>. (accessed Jan. 6, 2009), 3 pages.

News Release, Halozyme Therapeutics Inc., "Halozyme Therapeutics Completes Enrollment in Chemophase Phase I/IIa Clinical Trial for Superficial Bladder Cancer," San Diego, CA, Sep. 25, 2007, retrieved from the Internet:<URL: phx.corporate-ir.net/phoenix.zhtml?c=175436&p=irol-newsArticle_Print&ID=1055493&highlight=>. (accessed Jan. 6, 2009), 2 pages.

News Release, Halozyme Therapeutics Inc., "Halozyme Therapeutics Releases Results of Enhanze Technology Clinical Trial to Improve the Subcutaneous Absorption of a Large Protein Molecule Therapeutic," San Diego, CA, Jan. 22, 2007, retrieved from the Internet:<URL: phx.corporateir.net/phoenix.zhtml?c=175436&p=irol-newsArticle_Print&ID=952285&highlight=>. (accessed Jan. 6, 2009), 3 pages.

News Release, Halozyme Therapeutics Inc., "Halozyme Therapeutics Completes Enrollment of Enhanze Technology Clinical Trial to Improve the Subcutaneous Absorption of a Large Protein Molecule Therapeutic," San Diego, CA, Nov. 27, 2006, retrieved from the Internet:<URL: pluccorporate-innet/phoenix.zhtml?c=175436&p=irol-newsArticle_Print&ID=935824&highlight=>. (accessed Jan. 6, 2009), 2 pages.

News Release, Halozyme Therapeutics Inc., "Halozyme Therapeutics Completes Enrollment of Infuse-Morphine Clinical Trial," San Diego, CA, Oct. 10, 2006, retrieved from the Internet:<URL: phx.corporate-ir.net/phoenix.zhtml?c=175436&p=irol-newsArticle_Print&ID=913828&highlight=>. (accessed Jan. 6, 2009), 2 pages.

News Release, Halozyme Therapeutics Inc., "Halozyme Therapeutics Initiates First Enhanze Technology Clinical Trial to Improve the Subcutaneous Absorption of a Large Molecule Protein Therapeutic," San Diego, CA, Aug. 8, 2006, retrieved from the Internet:<URL: phx.corporate-ir.net/phoenix.zhtml?c=175436&p=irol-newsArticle_Print&ID=893361&highlight=>.(accessed Jan. 6, 2009), 2 pages.

News Release, Halozyme Therapeutics Inc., "Halozyme Therapeutics Announces Fda 510(k) Clearance for MediCult's SynVitro Cumulase Product," San Diego, CA, May 23, 2006, retrieved from the Internet:<URL: phx.corporate-ir.net/phoenix.zhtml?c=175436&p=irol-newsArticle_Print&ID=859761&highlight=>. (accessed Jan. 6, 2009), 2 pages.

News Release, Halozyme Therapeutics Inc., "Halozyme Therapeutics Announces 22% Increase in IVF ICSI Fertilization Rates in Eggs Treated With Cumulase Versus Bovine Extract," San Diego, CA, May 4, 2006, http://phx.corporate-ir.net/phoenix.zhtml?c=175436&p=irol-newsArticle_Print&ID=852102&highlight= (accessed Jan. 6, 2009), 3 pages.

News Release, Halozyme Therapeutics Inc., "Halozyme Therapeutics Initiates Chemophase Phase I/IIa Clinical Trial for Superficial Bladder Cancer," San Diego, CA, Apr. 26, 2006, retrieved from the Internet:<URL: phx.corporate-ir.net/phoenix.zhtml?c=175436&p=irol-newsArticle_Print&ID=847794&highlight=>. (accessed Jan. 6, 2009), 2 pages.

News Release, Halozyme Therapeutics Inc., "Halozyme Therapeutics Completes Enrollment of Chemophase Phase I Clinical Trial for Superficial Bladder Cancer," San Diego, CA, Mar. 6, 2006, retrieved from the Internet:<URL: phx.corporate-ir.net/phoenix.zhtml?c=175436&p=irol-newsArticle_Print&ID=827129&highlight=>. (accessed Jan. 6, 2009), 2 pages.

News Release, Halozyme Therapeutics Inc., "Halozyme Therapeutics and Baxter Release Results From the INFUSE-LR Study," San Diego, CA, and Deerfield, IL, Feb. 8, 2006, retrieved from the Internet:<URL: phx.corporate-ir.net/phoenix.zhtml?c=175436&p=irol-newsArticle_Print&ID=814561&highlight=>. (accessed Jan. 6, 2009), 4 pages.

News Release, Halozyme Therapeutics Inc., "Halozyme Therapeutics Initiates Clinical Trial of Subcutaneous Morphine With Hylenex," San Diego, CA, Feb. 2, 2006, retrieved from the Internet:<URL: phx.corporate-ir.net/phoenix.zhtml?c=175436&p=irol-newsArticle_Print&ID=811906&highlight=>. (accessed Jan. 6, 2009), 2 pages.

News Release, Halozyme Therapeutics Inc., "Halozyme Therapeutics Completes Enrollment of INFUSE-LR, a Hylenex Clinical Trial of Subcutaneous Hydration," San Diego, CA, Jan. 24, 2006, retrieved from the Internet:<URL: phx.corporate-ir.net/phoenix.zhtml?c=175436&p=irol-newsArticle_Print&ID=807598&highlight=>. (accessed Jan. 6, 2009), 2 pages.

News Release, Halozyme Therapeutics Inc., "Halozyme Therapeutics Initiates Hylenex Clinical Trial of Subcutaneous Hydration," San Diego, CA, Dec. 15, 2005, retrieved from the Internet:<URL: phx.corporate-innet/phoenix.zhtml?c=175436&p=irol-newsArticle_Print&ID=796125&highlight=>. (accessed Jan. 6, 2009), 2 pages.

News Release, Halozyme Therapeutics Inc., "Halozyme Therapeutics and Baxter Healthcare Corporation Announce FDA Approval of Hylenex," San Diego, CA, and Deerfield, IL, Dec. 5, 2005, retrieved from the Internet:<URL: phx.corporate-ir.net/phoenix.zhtml?c=175436&p=irol-newsArticle_Print&ID=792608&highlight=>. (accessed Jan. 6, 2009), 3 pages.

News Release, Halozyme Therapeutics Inc., "Halozyme Therapeutics Initiates Chemophase Phase I Clinical Trial for Superficial Bladder Cancer—First Patients Treated," San Diego, CA, Oct. 27, 2005, retrieved from the Internet:<URL: phx.corporate-ir.net/phoenix.zhtml?c=175436&p=irol-newsArticle_Print&ID=774533&highlight=>. (accessed Jan. 6, 2009), 2 pages.

News Release, Halozyme Therapeutics Inc., "Halozyme Therapeutics Receives FDA Clearance to Initiate Chemophase Clinical Trial," San Diego, CA, Aug. 11, 2005, retrieved from the Internet:<URL: phx.corporate-ir.net/phoenix.zhtml?c=175436&p=irol-newsArticle_Print&ID=742261&highlight=>. (accessed Jan. 6, 2009), 2 pages.

News Release, Halozyme Therapeutics Inc., "Halozyme Therapeutics Announces Submission of Investigational New Drug Application for Chemophase," San Diego, CA, Jun. 30, 2005, retrieved from the Internet:<URL: phx.corporate-ir.net/phoenix.zhtml?c=175436&p=irol-newsArticle_Print&ID=725295&highlight=>. (accessed Jan. 6, 2009), 2 pages.

News Release, Halozyme Therapeutics Inc., "Halozyme Therapeutics and Reproductive Biology Associates Announce New Clinical Data in IVF: Significantly Increased Fertilization Rates With Cumulase," Copenhagen, Denmark, Jun. 22, 2005, retrieved from the Internet:<URL: phx.corporate-ir.net/phoenix.zhtml?c=175436&p=irol-newsArticle_Print&ID=722843&highlight=>. (accessed Jan. 6, 2009), 3 pages.

News Release, Halozyme Therapeutics Inc., "Halozyme Therapeutics Announces Launch of Cumulase for In Vitro Fertilization," San Diego, CA, Jun. 20, 2005, retrieved from the Internet:<URL: phx.corporate-ir.net/phoenix.zhtml?c=175436&p=irol-newsArticle_Print&ID=721999&highlight=>. (accessed Jan. 6, 2009), 2 pages.

News Release, Halozyme Therapeutics Inc., "Halozyme Therapeutics Announces FDA Acceptance of Hylenex NDA," San Diego, CA, May 26, 2005, retrieved from the Internet:<URL: phx.corporate-ir.net/phoenix.zhtml?c=175436&p=irol-newsArticle_Print&ID=714327&highlight=>. (accessed Jan. 6, 2009), 2 pages.

News Release, Halozyme Therapeutics Inc., "Halozyme Therapeutics Receives FDA 510(k) Clearance for Cumulase," San Diego, CA, Apr. 19, 2005, retrieved from the Internet:<URL: phx.corporate-ir.net/phoenix.zhtml?c=175436&p=irol-newsArticle_Print&ID=697535&highlight=>. (accessed Jan. 6, 2009), 2 pages.

(56) References Cited

OTHER PUBLICATIONS

News Release, Halozyme Therapeutics Inc., "Halozyme Therapeutics Files NDA for Enhanze SX," San Diego, CA, Mar. 28, 2005, retrieved from the Internet:<URL: phx.corporate-ir.net/phoenix.zhtml?c=175436&p=irol-newsArticle_Print&ID=689194&highlight=>. (accessed Jan. 6, 2009), 2 pages.

News Release, Halozyme Therapeutics Inc., "Halozyme Therapeutics Receives CE Mark for Cumulase," San Diego, CA, Dec. 28, 2004, retrieved from the Internet:<URL: phx.corporate-ir.net/phoenix.zhtml?c=175436&p=irol-newsArticle_Print&ID=657724&highlight=>. (accessed Jan. 6, 2009), 2 pages.

News Release, Halozyme Therapeutics Inc., "Halozyme Therapeutics Files 510(k) Application for Cumulase for In Vitro Fertilization," San Diego, CA, Sep. 14, 2004, retrieved from the Internet:<URL: phx.corporate-ir.net/phoenix.zhtml?c=175436&p=irol-newsArticle_Print&ID=613647&highlight=>. (accessed Jan. 6, 2009), 2 pages.

News Release, Halozyme Therapeutics Inc., "Halozyme therapeutics presents rHuPH20 hyaluronidase preclinical data at the 2005 association for research in vision and ophthalmology annual meeting," Fort Lauderdale, FL, May 2, 2005, retrieved from the Internet:<URL: www2.prnewswire.comic gi-bin/stories.pl?ACCT=104&STORY=/www/story/05-02-2005/0003536239&EDATE=>. (May 2, 2005) [retrieved on Jun. 23, 2009] [2 pages].

News Release, Halozyme Therapeutics Inc., "Phase III Trial Begins for Gammagard Liquid Plus rHuPH20 in Primary Immunodeficiency Patients," San Diego, CA, Jan. 5, 2009, retrieved from the Internet:<URL: phx.corporate-ir.net/phoenix.zhtml?c=175436&p=irol-newsArticle_Print&ID=1240232&highlight=>. (accessed Jan. 6, 2009), 3 pages.

News Release, Halozyme Therapeutics Inc., Q1 2008 Earnings Call Transcript retrieved from the Internet:<URL: seekingalpha.com/article/76655-halozyme-therapeutics-inc-q1-2008-earnings-calltranscript>. [accessed on Jun. 25, 2009] [14 pages].

News Release, Halozyme Therapeutics Inc., Q4 2008 Earnings Call Transcript retrieved from the Internet:<URL: seekingalpha.com/article/125929-halozyme-therapeutics-inc-q4-2008-earnings-calltranscript>. [accessed on May 13, 2009] [12 pages].

Ohya, T. and Y. Kaneko, "Novel hyaluronidase from streptomyces," Biochim. Biophys. Acta 198:607-609 (1970).

Omaetxebarria et al., "Computational approach for identification and characterization of GPI-anchored peptides in proteomics experiments," Proteomics 7(12):1951-1960 (2007).

Ornitz et al., "Elastase I promoter directs expression of human growth hormone and SV40 T antigen genes to pancreatic acinar cells in transgenic mice," Cold Spring Harbor Symp. Quant. Biol. 50:399-409 (1986).

Pargiter, R., "Use of hyaluronidase in insulin coma," Dis Nery Syst 18(5):194-195 (1957).

Paul, A. and D. Sochart, "Improving the results of ganglion aspiration by the use of hyaluronidase," J Hand Surg 22(2):219-221 (1997).

Paulick, M. and C. Bertozzi, "The glycosylphosphatidylinositol anchor: A complex membrane-anchoring structure for proteins," Biochemistry 47:6991-7000 (2008).

Pawlowski et al., "The effects of hyalurodinase upon tumor formation in BALB/c mice painted with 7,12-dimethylbenz-(a)anthracene," Int. J. Cancer 23:105-109 (1979).

Pearson, W. and D. Lipman "Improved tools for biological sequence comparison," Proc. Natl. Acad. Sci. USA 85:2444 (1988).

Pham et al., "Large-scale transient transfection of serum-free suspension-growing HEK293 EBNA1 cells: peptone additives improve cell growth and transfection efficiency," Biotechnology and Bioengineering 84:332-342 (2003).

Phelps et al., "Restricted lateral diffusion of PH-20, a PI-anchored sperm membrane protein," Science 240:1780-1782 (1988).

Pierleoni et al., PredGPI: a GPI-anchor predictor, BMC Bioinformatics 9:392 (2008).

Pinkert et al., "An albumin enhancer located 10 kb upstream functions along with its promoter to direct efficient, liver-specific expression in transgenic mice," Genes and Devel. 1(3):268-276 (1987).

Pinkstaff et al., "Evaluation of the compatibility and pharmacokinetics of co-formulated biologics with recombinant human hyaluronidase: Dose Response," American Association of Pharmaceutical Scientists Conference, Jun. 2006, San Antonio, TX, 3 pages.

Pinkstaff et al., "Recombinant human hyaluronidase for drug and fluid dispersion," American Association of Pharmaceutical Scientists Annual Meeting, Nov. 2006, Boston, MA, 3 pages.

Pinkstaff et al., "Recombinant human hyaluronidase for use with therapeutic antibodies," Controlled Release Society Conference, Vienna, Austria, 2006, 2 pages.

Pirinen et al., "Prognostic value of hyaluronan expression in non-small cell lung cancer: Increased stromal expression indicated unfavorable outcome in patients with adenocarcinoma," Int. J. Cancer 95:12-17 (2001).

Pirrello et al., "Initial experiences with subcutaneous recombinant human hyaluronidase," J Palliat Med. 10(4):861-864 (2007).

Premaratne et al., "Effects of hyaluronidase on reducing myocardial infarct size in a baboon model of ischemia-reperfusion injury," J of Surgical Research 58:205-210 (1995).

Prenner et al., "The antigenicity of the carbohydrate moiety of an insect glycoprotein, honey-bee (Apis mellifera) venom phospholipase A2. The role of alpha 1,3-fucosylation of the asparagine-bound N-acetylglucosamine," Biochem J. 284(Pt 2):377-380 (1992).

Ramsden et al, "A new disorder of hyaluronan metabolism associated with generalized folding and thickening of the skin," J. Pediatr. 136:62-68 (2000).

Readhead et al., "Expression of a myelin basic protein gene in transgenic shiverer mice: correction of the dysmyelinating phenotype," Cell 48:703-712 (1987).

Reit Correa et al., "Potentialization of the action of insulin by hyaluronidase" Annales d'endocrinologie 23:27 (1962). [in the French language].

Rhodes et al., "Transformation of maize by electroporation of embryos," Methods Mol Biol 55:121-131 (1995).

Ripka et al., "Two Chinese hamster ovary glycosylation mutants affected in the conversion of GDP-mannose to GDP-fucose," Arch. Biochem. Biophys. 249(2):533-545 (1986).

Roberts et al., "Chemistry for peptide and protein PEGylation," Advanced Drug Delivery Review 54:459-476 (2002).

Ropponen et al., "Tumor cell-associated Hyaluronan as an unfavorable prognostic factor in colorectal cancer," Cancer Research 58(2):342-347 (1998).

Salkie, M., "Glycosaminoglycan metabolism following acute myocardial infarction and the effects of intraveneous hyaluronidase therapy," Clin. Biochem. 13(2):92-94 (1980).

Sato, H., "Enzymatic procedure for site-specific pegylation of proteins," Adv. Drug Deliv. Rev. 54:487-504 (2002).

Scharf et al., "Heat stress promoters and transcription factors," Results Probl Cell Differ 20:125-162 (1994).

Scheithauer et al., "In vitro evaluation of the anticancer drug modulatory effect of hyaluronidase in human gastrointestinal cell lines," Anticancer Res. 8:391-396 (1988).

Schuller et al., "Pharmacokinetics of intrahepatic 5-fluorouracil + preinjected hyaluronidase," Proc. Amer. Assoc. Cancer Res. 32:173, abstract No. 1034 (1991).

Schwartz, R. and M. Dayhoff, eds., Atlas of Protein Sequence and Structure, National Biomedical Research Foundation, pp. 353-358 (1979).

Seaton et al., "Rat sperm 2B1 glycoprotein (PH20) contains a C-terminal sequence motif for attachment of a glycosyl phosphatidylinositol anchor. Effects of endoproteolytic cleavage on hyaluronidase activity," Biol Reprod. 62(6):1667-1676 (2000).

Setala et al., "Hyaluronan expression in gastric cancer cells is associated with local and nodal spread and reduced survival rate," Br J Cancer 79(7-8):1133-1138 (1999).

Shani, M., "Tissue-specific expression of rat myosin light-chain," Nature 314:283-286 (1985).

Shekhar, C., "The matrix reloaded: Halozyme's recombinant enzyme helps injected drugs spread faster," Chem. Biol. 14:603-604 (2007).

Shepard, M., "PEGPH20—a targeted therapy for cancer treatment," presented at Target Discovery World Congress, South San Francisco, CA., Aug. 4-5, 2009 (13 pages).

(56) References Cited

OTHER PUBLICATIONS

Shimizu, Y. and H. Yoshikura, "Multicycle infection of hepatitis C virus in cell culture and inhibition by alpha and beta interferons," J. Virol. 68:8406-8408 (1994).
Shuster et al., "Hyaluronidase reduces human breast cancer xenografts in SCID mice," Int. J. Cancer 102:192-197 (2002).
Smith, T. and M. Waterman, "Comparison of biosequences," Adv. Appl. Math 2:482-489 (1981).
St Croix et al., "Reversal of intrinsic and acquired forms of drug resistance by hyaluronidase treatment of solid tumors," Cancer Lett 131(1):35-44 (1998).
Steinkuhler et al., "Product inhibition of the hepatitis C virus NS3 protease," Biochem. 37:8899-8905 (1998).
Stern, R., "Devising a pathway for hyaluronan catabolism: are we there yet?" Glycobiology 13(12):105R-115R (2003).
STN GEN Caesar accession No. 1625, File IMSDRUGNEWS citing: "rHuPH20 Halozyme phase change II, USA (diabetes)," R&D Focus Drug News, Nov. 2008 (4 pages).
Straccia, F. and A. Scheflen, "Hyaluroidase as an adjunct in insulin coma therapy," Am J Psychiatry 108:702-703 (1952).
Sturla et al., "Core fucosylation of N-linked glycans in leukocyte adhesion deficiency/congenital disorder of glycosylation IIc fibroblasts," Glycobiology 15(10):924-935 (2005).
Sudo et al., "Establishment of an in vitro assay system for screening hepatitis C virus protease inhibitors using high performance liquid chromatography," Antiviral Res. 32:9-18 (1996).
Sugarman, B., "Recombinant Human Hyaluronidase (rHuPH20) accelerates insulin pharmacokinetics in dogs" Jun. 23, 2009 AAPS National Biotechnology Conference, 2 pages.
Swift et al., "Tissue-specific expression of the rat pancreatic elastase I gene in transgenic mice," Cell 38:639-646 (1984).
Takahashi et al., "A fluorimetric Morgan-Elson assay method for hyaluronidase activity," Anal. Biochem. 322:257-263 (2003).
Takeshita et al., "An enzyme-linked immunosorbent assay for detecting proteolytic activity of hepatitis C virus proteinase," Anal. Biochem. 247:242-246 (1997).
Taliani et al., "A continuous assay of hepatitis C virus protease based on resonance energy transfer depsipeptide substrates," Anal. Biochem. 240:60-67 (1996).
Taylor et al., "Comparison of bovine- and recombinant human-derived hyaluronidase with regard to fertilization rates and embryo morphology in a sibling oocyte model: a prospective, blinded, randomized study," Fertility & Sterility 85:1544-1546 (2006).
Thomas et al., "The INFUSE-Morphine Study: Use of Recombinant Human Hyaluronidase (rHuPH20) to Enhance the Absorption of Subutaneously Administered Morphine in Patients with Advanced Illness," Journal of Pain and Symptom Management 38(5):663-672 (2009).
Thomas et al., "Assessing the Role of Human Recombinant Hyaluronidase in Gravity-Driven Subcutaneous Hydration: The INFUSE-LR Study," J Palliat Med. 10:1312-1320 (2007).
Thomas et al., Can human recombinant hyaluronidase enhance the absorption of subcutaneously administered morphine? The INFUSE-Morphine Study, presented at: Annual Assembly of Hospice and Palliative Medicine; Feb. 15-18, 2007; Salt Lake City, UT, 1 page.
Thomas et al., "Enhanced morphine absorption following subcutaneous administration of morphine + recombinant human hyaluronidase: Pharmacokinetics and safety in healthy volunteers," Presented at: Annual Meeting of the Infusion Nurses Society; Jun. 4-7, 2007; Orlando, FL, 1 page.
Thomas et al., "Enhanced subcutaneous morphine absorption with recombinant human hyaluronidase (rHuPH20) in healthy volunteers," Presented at: Annual Meeting of National Hospice & Palliative Care Organization; Nov. 29-Dec. 1, 2007; New Orleans, LA, 2 pages.
Thomas et al., "Human recombinant hyaluronidase (rHuPH20) enhances subcutaneous administration of morphine in palliative care patients and healthy volunteers," Presented at: Annual Meeting of the Infusion Nurses Society; Jun. 4-7, 2007; Orlando, FL, 1 page.
Thomas et al., "Pooled safety and tolerability data from three pharmacokinetic studies of subcutaneous administration of morphine + human recombinant hyaluronidase (rHuPH20)," Oral presentation at: Annual Meeting of the Infusion Nurses Society; Jun. 4-7, 2007; Orlando, FL, 2 pages.
Thomas et al., "Recombinant human hyaluronidase enhances subcutaneous morphine absorption: Results from three pharmacokinetic and safety trials," Presented at: 38th Annual American Society of Consultant Pharmacists Meeting and Exhibition, Nov. 14-17, 2007; Philadelphia, PA, 1 page.
Thomas et al., "Recombinant Human Hyaluronidase enhances subcutaneous morphine absorption in palliative care patients and volunteer subjects," Presented at: Annual Meeting of National Hospice & Palliative Care Organization; Nov. 29-Dec. 1, 2007; New Orleans, LA, 2 pages.
Thomas et al., "Recombinant human hyaluronidase with SC morphine: 3 trials," Poster presented at: Annual Meeting of the American Academy of Pain Management; Sep. 27-30, 2007; Las Vegas, NV, 1 page.
Thomas et al., "Safety and tolerability in subcutaneous morphine coadministered with recombinant human hyaluronidase in palliative care patients and volunteers," Presented at: Annual Meeting of National Hospice & Palliative Care Organization; Nov. 29-Dec. 1, 2007; New Orleans, LA, 2 pages.
Thomas et al., "Safety and tolerability of subcutaneous administration of morphine + recombinant human hyaluronidase (rHuPH20): Pooled data from three pharmacokinetic studies," Presented at: Annual Meeting of the Society of Hospital Medicine; May 23-25, 2007; Dallas, TX, 1 page.
Thomas et al., "Safety of morphine + recombinant human hyaluronidase: 3 trials," Poster presented at: Annual Meeting of the American Academy of Pain Management; Sep. 27-30, 2007; Las Vegas, NV, 1 page.
Thomas et al., "Subcutaneous administration of morphine 30 recombinant human hyaluronidase (rHuPH20) enhances morphine absorption in palliative care patients and healthy volunteers," Presented at: Annual Meeting of the Society of Hospital Medicine; May 23-25, 2007; Dallas, TX, 1 page.
Thomas et al., "Subcutaneous morphine + recombinant human hyaluronidase: Pooled safety and tolerability results from three pharmacokinetic trials," Presented at: Presented at: 38th Annual American Society of Consultant Pharmacists Meeting and Exhibition, Nov. 14-17, 2007; Philadelphia, PA, 1 page.
Thompson et al., "Intravenous administration of recombinant human hyaluronidase (rHuPH20) modulates tumor interstitial fluid pressure and pericellular hyaluronan in a human prostate carcinoma xenograft model," American Association for Cancer Research Annual Meeting, 2008, San Diego, CA, 3 pages.
Thompson Pharma, "The ones to watch," Pharma Matters Report (2008) retrieved from the Internet<URL: thomsonreuters.com/content/PDF/scientific/pharma/2008totw_q4.pdf, [retrieved on Dec. 16, 2009] [12 pages].
Trese, M., "Enzymatic-assisted vitrectomy," Eye 16:365-368 (2002).
Tsubery et al., "Prolonging the action of protein and peptide drugs by a novel approach of reversible polyethylene glycol modification," J Biol. Chem 279(37):38118-38124 (2004).
Tyle, P., "Iontophoretic devices for drug delivery," Pharmaceutical Research 3(6):3-18 (1986).
Tyndel, M., "Hyaluronidase as an adjuvant in insulin shock therapy," J Am Med Assoc 162(1):32-34 (1956).
Udenfriend, S. and K. Kodukula, "Prediction of omega site in nascent precursor of glycosylphosphatidylinositol protein," Methods Enzymol. 250:571-582 (1995).
USP XXII-NF XVII (1990) 644-645 United States Pharmacopeia Convention, Inc, Rockville, MD.
Varnell et al., "Effect of recombinant human hyaluronidase on intraocular pressure in rabbits following injection of viscoelastic substances," Association for Research in Vision and Ophthalmology Annual Meeting, 2005 Fort Lauderdale, FL, 2 pages.
Vaughn et al., "Accelerated pharmacokinetics and glucodynamics of prandial insulins injected with recombinant human hyaluronidase," Diabetes Technology & Therapeutics 345-352 (2009).

(56) References Cited

OTHER PUBLICATIONS

Veronese et al., "Branched and Linear Poly(Ethylene Glycol): Influence of the Polymer Structure on Enzymological, Pharmacokinetic, and Immunological Properties of Protein Conjugates," J. Bioactive Compatible Polymers 12:197-207 (1997).
Voyer et al., "Insulinotherapie avec alidase en plusieurs injections," L'Union Med. Canada 86:861-865 (1957). [in the French language].
Wagner et al., "Nucleotide sequence of the thymidine kinase gene of herpes simplex virus type 1," Proc. Natl. Acad. Sci. USA 78:1441-1445 (1981).
Waldenstrom et al, "Accumulation of hyaluronan and tissue edema in experimental myocardial infarction," J Clin Invest 88(5):1622-1628 (1991).
Waldenstrom et al., "Coxsackie B3 myocarditis induces a decrease in energy charge and accumulation of hyaluronan in the mouse heart," Eur J Clin Invest 23:277-282 (1993).
Wallander et al., "Intestinal distribution of hyaluronan in small bowel allografting in the rat," Transplant Int 6:133-137 (1993).
Wei et al., "Structure function analysis of the human hyaluronidase enzymes," American Society for Matrix Biology Biennial Meeting, San Diego, CA, Dec. 5, 2008, 2 pages.
Wei et al., "Functions of N-linked glycans on human hyaluronidase PH20," poster 83, 1 page (2009).
Wells et al, "The localization of hyaluronan in normal and rejected human kidneys," Transplantation 50:240-243 (1990).
Weng, S. and R. Spiro, "Demonstration that a kifunensine-resistant alpha-mannosidase with a unique processing action on N-linked oligosaccharides occurs in rat liver endoplasmic reticulum and various cultured cells," J Biol. Chem 268(34):25656-25663 (1993).
White et al., "Comparison of the glycosyl-phosphatidylinositol cleavage/attachment site between mammalian cells and parasitic protozoa," J. Cell Sci. 113(Pt.4):721-727 (2000).
Wigler et al., "Transfer of purified herpes virus thymidine kinase gene to cultured mouse cells," Cell 11:223-232 (1977).
Wigler et al., "Transformation of mammalian cells with an amplifiable dominant-acting gene," Proc Natl Acad Sci. USA 77:3567-3570 (1980).
Wilson, M. "Enhanze Technology—An Enzymatic Drug Delivery System (DDS)," Japanese Export Trade Organization, 2005, Santa Clara, CA, 22 pages.
Wolf et al., "Intravenous bovine testicular hyaluronidase depolymerizes myocardial hyaluronic acid in dogs with coronary artery occlusion," Circ. Res. 48:88-95 (1981).
Wolf, et. al., "The serum kinetics of bovine testicular hyaluronidase in dogs, rats and humans," J Pharmacol Exp Ther 222(2):331-337 (1982).
Yamamoto et al., "Identification of a functional promoter in the long terminal repeat of Rous sarcoma virus," Cell 22:787-797 (1980).
Yamane-Ohnuki et al., "Establishment of FUT8 knockout Chinese hamster ovary cells: an ideal host cell line for producing completely defucosylated antibodies with enhanced antibody-dependent cellular cytotoxicity," Biotech. Bioeng. 87:614-622 (2004).
Yocum et al., "Assessment and implication of the allergic sensitivity to a single dose of recombinant human hyaluronidase injection: a double-blind placebo-controlled clinical trial," J Infus Nursing. 30:293-299 (2007).
Yocum et al., "Pharmacokinetics and glucodynamics of an insulin analog and regular insulin injected with recombinant human hyaluronidase: Fast-acting insulins made faster," American Diabetes Association 68$^{th}$ Scientific Sessions, San Francisco, CA, Jun. 6-10, 2008, 2-LB. 2 pages.
Yudin et al., "Characterization of the active site of monkey sperm hyaluronidase," Reproduction. 121(5):735-743 (2001).
Zalipsky, S. and C. Lee, "Poly(ethylene glycol) Chemistry: Biotechnical and Biomedical Applications," Hams, J. ed., Plenum: NY, Chapter 21, pp. 347-370 (1992).
Zalipsky, S., "Chemistry of polyethylene glycol conjugates with biologically active molecules," Adv. Drug Del. Rev. 16:157-182 (1995).
Zanker et al., "Induction of response in previous chemotherapy resistant patients by hyaluronidase," Proc. Amer. Assoc. Cancer Res. 27:390 Abstract 1550 (1986).
Zhao, X. And J. Harris, in "Poly(ethylene glycol), Chemistry and Biological Applications" ACS Symposium Series 680, Hams, J. and Zalipsky, S. (eds), 458-472 (1997).
U.S. Appl. No. 12/381,844, filed Mar. 16, 2009.
International Search Report and Written Opinion, issued Apr. 20, 2010, in connection with corresponding International Patent Application No. PCT/US2009/006501.
Kadhim et al., "Synergistic anti-tumor effects of pegylated recombinant human hyaluronidase (PEGPH20) eith Gemcitabine in subcutaneous pancreatic cancer xenograft models," AACR 101st Annual Meeting, Washington, D.C., Apr. 21, 2010 [2 pages].
Lim et al "Matrix Therapies for life" 28th Annual JP Morgan Healthcare Conference San Francisco Jan. 13, 2010, 42 pages.
Muchmore et al., "Review of the Mechanisms of Action and Clinical Efficacy of Recombinant Human Hyaluronidase Coadministration with Current Prandial Insulin Formulations," J Diabetes Sci Technol 4(2):419-428 (2010).
U.S. Appl. No. 12/660,869, filed Mar. 4, 2010.
U.S. Appl. No. 12/660,893, filed Mar. 4, 2010.
U.S. Appl. No. 12/802,864, filed Jun. 15, 2010.
Letter/Written Disclosure of the Supplemental Information Disclosure Statement for the above-referenced application, mailed Aug. 13, 2014, 2 pages.
Office Action, mailed Jul. 31, 2014, in connection with U.S. Appl. No. 13/385,527, 15 pages.
Examination Report, issued Sep. 30, 2013, in connection with Australian Patent Application No. 2009333918, 3 pages.
Response, dated May 12, 2014, to Examination Report, issued Sep. 30, 2013, in connection with Australian Patent Application No. 2009333918, 33 pages.
Notice of Acceptance, mailed May 22, 2014, in connection with Australian Patent Application No. 2009333918, 2 pages.
Examination Report, issued Jan. 2, 2014, in connection with Australian Patent Application No. 2013202000, 3 pages.
Response, dated Feb. 28, 2013, to Examination Report, issued Dec. 17, 2013, in connection with New Zealand Patent Application No. 604357, 19 pages.
Examiner's Report, issued Feb. 25, 2014, in connection with Canadian Patent Application No. 2,746,181, 3 pages.
Instructions, dated Oct. 30, 2013, for response to Office Action and Search Report, issued Jul. 2, 2012 in connection with Chinese Patent Application No. 200980156387.7, 8 pages.
Instructions, dated Jun. 25, 2014, for response to Office Action, received Mar. 20, 2014, in connection with Chinese Patent Application No. 201310106164.8, 14 pages.
Communication, dated Mar. 4, 2014, providing translation of Official Action, issued Jan. 28, 2014, in connection with Columbian Patent Application No. 11-085406 [English translation], 4 pages.
Instructions, dated Mar. 10, 2014, for response to Official Action, issued Jan. 28, 2014, in connection with Columbian Patent Application No. 11-085406, 6 pages.
Resolution No. 2465, issued Jan. 28, 2014 in connection with Columbian Patent Application No. 11-085406 [English translation], 9 pages.
Examination Report, dated Sep. 9, 2013, issued in connection with European Patent Application No. 09804345.8, 5 pages.
Response, dated Mar. 17, 2014, to Communication under Article 94(3), dated Sep. 9, 2013, issued in connection with European Patent Application No. 09804345.8, 6 pages.
Communication pursuant to Article 94(3) EPC (Examination Report), dated Jun. 26, 2014, issued in connection with European Patent Application No. 09804345.8, 4 pages.
Instructions, dated Feb. 20, 2014, for response to Office Action, issued Aug. 27, 2013, in connection with Japanese Patent Application No. 2011-540704, 15 pages.
Response, dated Feb. 12, 2014, to Office Action, issued Aug. 15, 2013, in connection with Israeli Patent Application No. 213150, 13 pages.

(56) References Cited

OTHER PUBLICATIONS

Instructions for appeal, dated Dec. 24, 2013, in response to Office Action, issued Sep. 30, 2013, in connection with Korean Patent Application No. 10-2011-7015830, 12 pages.

Office Action, issued Jan. 29, 2014, in connection with Korean Patent Application No. 10-2011-7015830, 5 pages.

Instructions, dated Jul. 23, 2014, for response to Office Action, issued Jan. 29, 2014, in connection with Korean Patent Application No. 10-2011-7015830, 11 pages.

Office Action, issued Mar. 18, 2014, in connection with Korean Patent Application No. 10-20123-7034877, 7 pages.

Instructions, dated Jul. 23, 2014, for response to Office Action, issued Mar. 18, 2014, in connection with Korean Patent Application No. 10-20123-7034877, 14 pages.

Translation, dated Dec. 27, 2013, of Office Action, issued Dec. 9, 2013, in connection with Mexican Patent Application No. MX/2011/006110, 3 pages.

Instructions, dated Apr. 9, 2014, for response to Office Action, issued Dec. 9, 2013, in connection with Mexican Patent Application No. MX/2011/006110, 18 pages.

Final Examination Report, mailed Jan. 15, 2014, in connection with Singapore Patent Application No. 201104225-6, 6 pages.

Certificate of Grant, issued Jun. 26, 2014, in connection with Singapore Patent Application No. 201104225-6, 1 page.

Preliminary Examiner's Report, issued Nov. 10, 2011, in connection with Vietnamese Patent Application No. 1-2011-01785, 1 page.

Instructions for Response to Examiner's Report, issued Nov. 10, 2011, in connection with Vietnamese Patent Application No. 1-2011-01785 and filed amended claims, 25 pages.

* cited by examiner

| HumanPH20     | MGVLKFKHIFFRSFVKSSGVSQIVFTFLLIPCCLTLNFRAPPVIPNVPFLWAWNAPSEFC 60
| ChimpanzeePH20| MGVLKFKHIFFRSFVKSSGVSQIVFTFLLIPCCLTLNFRAPPVIPNVPFLWAWNAPSEFC 60
|               | ************************************************************

| HumanPH20     | LGKFDEPLDMSLFSFIGSPRINATGQGVTIFYVDRLGYYPYIDSITGVTVNGGIPQKISL 120
| ChimpanzeePH20| LGKFDEPLDMSLFSFIGSPRINVTGQDVTIFYVDRLGYYPYIDSITGVTVNGGIPQKISL 120
|               | ********************.*:*********************************

| HumanPH20     | QDHLDKAKKDITFYMPVDNLGMAVIDWEEWRPTWARNWKPDVYKNRSIELVQQQNVQLS 180
| ChimpanzeePH20| QDHLDKAKKDITFYMPVDNLGMAVIDWEEWRPTWARNWKPDVYKNRSIELVQQQNVQLS 180
|               | ************************************************************

| HumanPH20     | LTEATEKAKQEFEKAGKDFLVETIKLGKLLRPNHLWGYYLFPDCYNHHYKKPGYNGSCFN 240
| ChimpanzeePH20| LTEATEKAKQEFEKAGKDFLVETIKLGKLLRPNHLWGYYLFPDCYNHHYKKPGYNGSCFN 240
|               | ************************************************************

| HumanPH20     | VEIKRNDDLSWLWNESTALYPSIYLNTQQSPVAATLYVRNRVREAIRVSKIPDAKSPLPV 300
| ChimpanzeePH20| VEIKRNDDLSWLWNESTALYPSIYLNTQQSPVAATLYVRNRVQEAIRVSKIPDAKSPLPV 300
|               | ***************************************:****************

| HumanPH20     | FAYTRIVFTDQVLKFLSQDELVYTFGETVALGASGIVWGTLSIMRSMKSCLLLDNYMET 360
| ChimpanzeePH20| FVYTRIVFTDQVLKFLSQDELVYTFGETVALGASGIVWGTLSIMRSMKSCLLLDNYMET 360
|               | *.***********************************************************

| HumanPH20     | ILNPYIINVTLAAKMCSQVLCQEQGVCIRKNWNSSDYLHLNPDNFAIQLEKGGKFTVRGK 420
| ChimpanzeePH20| ILNPYIINVTLAAKMCSQVLCQEQGVCIRKNWNSSDYLHLNPDNFAIQLEKGGKFTVRGK 420
|               | ************************************************************

| HumanPH20     | PTLEDLEQFSEKFYCSCYSTLSCKEKADVKDTDAVDVCIADGVCIDAFLKPPMETEEPQI 480
| ChimpanzeePH20| PTLEDLEQFSEKFYCSCYSTLSCKEKADVKDTDAVDVCIADGVCIDAFLKPPMETEESQI 480
|               | *******************************************************.

| HumanPH20     | FYNASPSTLSATMFI-VSILFLIISSVASL 509
| ChimpanzeePH20| FYNASPSTLSATMFIDLCDLYLVPTSYLIL 510
|               | ***************  :*: **: .:*

FIG. 1

EXTENDED SOLUBLE PH20 POLYPEPTIDES AND USES THEREOF

RELATED APPLICATIONS

Benefit of priority is claimed to U.S. Provisional Application Ser. No. 61/281,240 to Ge Wei, Krishnasamy Panneerselvam, Louis Bookbinder and Gregory I. Frost, entitled "EXTENDED SOLUBLE PH20 POLYPEPTIDES AND USES THEREOF," filed Nov. 13, 2009; and to U.S. Provisional Application Ser. No. 61/201,384, to Ge Wei, Krishnasamy Panneerselvam, Louis Bookbinder and Gregory I. Frost, entitled "EXTENDED SOLUBLE PH20 POLYPEPTIDES AND USES THEREOF," filed Dec. 9, 2008. The subject matter of each of the above-referenced applications is incorporated by reference in its entirety.

This application is related to International Application No. PCT/US2009/006501, filed the same day herewith, entitled "EXTENDED SOLUBLE PH20 POLYPEPTIDES AND USES THEREOF," which claims priority to U.S. Provisional Application Ser. Nos. 61/281,240 and 61/201,384.

The subject matter of the above-noted related application is incorporated by reference in its entirety.

INCORPORATION BY REFERENCE OF SEQUENCE LISTING PROVIDED ON COMPACT DISCS

An electronic version on compact disc (CD-R) of the Sequence Listing is filed herewith in duplicate (labeled Copy #1 and Copy #2), the contents of which are incorporated by reference in their entirety. The computer-readable file on each of the aforementioned compact discs, created on Dec. 9, 2009, is identical, 683 kilobytes in size, and titled 3074SEQ.001.txt.

FIELD OF INVENTION

Soluble PH20 polypeptides are provided, including extended soluble PH20 polypeptides, and uses thereof. Also provided are other C-terminally truncated PH20 polypeptides and partially deglycosylated PH20 polypeptides and uses thereof.

BACKGROUND

Hyaluronan (hyaluronic acid; HA) is a polypeptide that is found in the extracellular matrix of many cells, especially in soft connective tissues. HA also is found predominantly in skin, cartilage, and in synovial fluid in mammals. Hyaluronan also is the main constituent of the vitreous of the eye. HA has a role in various physiological processes, such as in water and plasma protein homeostasis (Laurent T C et al (1992) *FASEB J* 6: 2397-2404). Certain diseases are associated with expression and/or production of hyaluronan. Hyaluronidases are enzymes that degrade hyaluronan. By catalyzing HA, hyaluronidases can be used to treat diseases or disorders associated with accumulation of HA or other glycosaminoglycans. Also, since HA is a major component of the interstitial barrier, hyaluronidase increases tissue permeability and therefore can be used to increase the dispersion and delivery of therapeutic agents. Various hyaluronidases have been used therapeutically (e.g. Hydase™, Vitrase™ and Wydase™), typically as dispersing and spreading agents in combination with other therapeutic agents. Many of these are ovine or bovine forms, which can be immunogenic for treatment of humans. Improved compositions of hyaluronidases that can be used for treatment are needed.

SUMMARY

Provided herein are soluble PH20 polypeptides, including extended soluble PH20 (esPH20) polypeptides, and compositions. The PH20 polypeptides provided herein are soluble proteins that are truncated at the C-terminus and include those that lack all of the GPI-anchor attachment signal sequence (e.g. are truncated at amino acid positions 450 to 490). Soluble PH20 polypeptides also include extended soluble PH20 polypeptides that retain one or more residues located in the GPI-anchor attachment signal sequence of the corresponding full length wild-type PH20 polypeptide. Also provided herein are other modified PH20 polypeptides that contain C-terminal truncations. Partially deglycosylated forms of any of the polypeptides also are provided. Also provided are methods of treatment using the PH20 polypeptides provided herein.

Provided herein are isolated substantially purified extended soluble PH20 (esPH20) hyaluronidases, that can be N-glycosylated or N-partially glycosylated. In some examples, the N-partially glycosylated esPH20 polypeptide contains at least an N-acetylglucosamine moiety linked to each of at least two N-linked moieties, such as, for example, amino acid residues 368 and 393 of SEQ ID NO:107 or residues corresponding to amino acid residues 368 and 393 of SEQ ID NO:107. In some aspects, the N-partially glycosylated esPH20 polypeptide contains at least two N-acetylglucosamine moieties linked to each of at least two N-linked moieties. The N-partially glycosylated esPH20 polypeptide provided herein also can contain a branched sugar.

Provided herein are esPH20 polypeptides that have the sequence of amino acids set forth in any of SEQ ID NOS: 60-63 and 102-104 or an allelic or species variant thereof. Also provided are esPH20 polypeptide variants having at least 40%, 45%, 50%, 55%, 65%, 70%, 75%, 80%, 85%, 90%, 91%, 92%, 93%, 94%, 95%, 96%, 97%, 98%, 99% sequence identity with any of SEQ ID NOS: 60-63 and 102-104 and retaining at least 30% of the hyaluronidase activity of the corresponding unmodified form or of a polypeptide that is encoded by a nucleic acid that encodes a polypeptide with amino acids 36-482 of SEQ ID NO:107. Such esPH20 polypeptides remain soluble and neutral active. In one example, the esPH20 is a human esPH20, such as one with a sequence of amino acids set forth in any of SEQ ID NOS: 60-63 and 102-104, or a chimpanzee esPH20, such as one with a sequence of amino acids set forth as amino acids 36-491, 36-492, 36-493, 36-494, 36-495, 36-496, 36-497 or 36-498 of SEQ ID NO:197.

Also provided herein are substantially purified PH20 polypeptides. These PH20 polypeptides can have a sequence of amino acids set forth in any of SEQ ID NOS: 55-63 and 64-95 or an allelic or species variant thereof. In other examples, the PH20 polypeptides are variants having at least 40%, 45%, 50%, 55%, 65%, 70%, 75%, 80%, 85%, 90%, 91%, 92%, 93%, 94%, 95%, 96%, 97%, 98%, 99% sequence identity with any of SEQ ID NOS: 55-63 and 64-95, that retain at least 30% of the hyaluronidase activity of the corresponding unmodified form or of a polypeptide that is encoded by a nucleic acid that encodes a polypeptide with amino acids 36-482 of SEQ ID NO:107. Such PH20 polypeptides are neutral active.

The PH20 polypeptides provided herein can be N-glycosylated or N-partially glycosylated. In some examples, the N-partially glycosylated esPH20 polypeptide contains at least an N-acetylglucosamine moiety linked to each of at least two N-linked moieties, such as, for example, amino acid residues 368 and 393 of SEQ ID NO:107 or residues corresponding to amino acid residues 368 and 393 of SEQ ID NO:107. In some aspects, the N-partially glycosylated PH20 polypeptide contains at least two N-acetylglucosamine moieties linked to each of at least two N-linked moieties. The N-partially glycosylated PH20 polypeptides provided herein also can contain a branched sugar. In some aspects, the PH20 polypeptides provided herein are soluble, and can be selected from among human, chimpanzee, rhesus monkey, cynomolgus monkey, mouse, rabbit, guinea pig, cow or sheep PH20.

The esPH20 and PH20 polypeptides provided herein can be modified by, for example, sialation, albumination, farnysylation, carboxylation, hydroxylation or phosphorylation. In some aspects, the esPH20 and PH20 polypeptides are modified by a polymer, such as dextran or PEG. Also provided herein are conjugates containing the esPH20 or PH20 polypeptides. Exemplary conjugates include those in which the esPH20 or PH20 is conjugated to a multimerization domain (such as an Fc domain), toxin, detectable label or drug.

Provided herein are nucleic acids encoding the esPH20 and PH20 polypeptides described above and provided herein. These nucleic acids include those that encode an esPH20 or PH20 polypeptide with amino acids corresponding to amino acids 36-450, 36-451, 36-452, 36-453, 36-454, 36-455, 36-456, 36-457, 36-458, 36-459, 36-460, 36-461, 36-462, 36-463, 36-464, 36-465, 36-484, 36-485, 36-486, 36-487, 36-489, 36-491, 36-492, 36-493, 36-494, 36-495, 36-496 or 36-497 of SEQ ID NO:107, and those that encode an esPH20 with amino acids corresponding to amino acids 36-491, 36-492, 36-493, 36-494, 36-495, 36-496, 36-497 or 36-498 of SEQ ID NO:197. Also provided herein are vectors that contain these nucleic acids. Further provided herein are cells that contain the vectors, such as prokaryotic or eukaryotic cells. For example, the cells can be mammalian cells, such as CHO cells.

Provided herein are compositions containing any one or more of the esPH20 or PH20 polypeptides described herein. In some examples, the compositions contain a plurality of esPH20 or PH20 polypeptides. For example, the compositions can contain a plurality of esPH20 polypeptides that are encoded by a nucleic acid molecule encoding amino acids corresponding to amino acids 36-450, 36-451, 36-452, 36-453, 36-454, 36-455, 36-456, 36-457, 36-458, 36-459, 36-460, 36-461, 36-462, 36-463, 36-464, 36-465, 36-484, 36-485, 36-486, 36-487, 36-489, 36-491, 36-492, 36-493, 36-494, 36-495, 36-496 or 36-497 of SEQ ID NO:107, and those that encode an esPH20 with amino acids corresponding to amino acids 36-491, 36-492, 36-493, 36-494, 36-495, 36-496, 36-497 or 36-498 of SEQ ID NO:197. In some examples, the compositions contain esPH20 or PH20 polypeptides that are secreted from CHO cells.

The compositions provided herein can be pharmaceutical compositions. In some examples, the compositions contain an additional therapeutic agent, which can be formulated with the composition or in a separate composition. Exemplary of the therapeutic agents that can be included in the compositions provided herein are chemotherapeutic agents, analgesic agents, anti-inflammatory agents, antimicrobial agents, amoebicidal agents, trichomonocidal agents, anti-parkinson agents, anti-malarial agents, anticonvulsant agents, anti-depressant agents, anti-arthritics agents, anti-fungal agents, antihypertensive agents, antipyretic agents, anti-parasite agents, antihistamine agents, alpha-adrenergic agonist agents, alpha blocker agents, anesthetic agents, bronchial dilator agents, biocide agents, bactericide agents, bacteriostat agents, beta adrenergic blocker agents, calcium channel blocker agents, cardiovascular drug agents, contraceptive agents, decongestant agents, diuretic agents, depressant agents, diagnostic agents, electrolyte agents, hypnotic agents, hormone agents, hyperglycemic agents, muscle relaxant agents, muscle contractant agents, ophthalmic agents, parasympathomimetic agents, psychic energizer agents, sedative agents, sympathomimetic agents, tranquilizer agents, urinary agents, vaginal agents, viricide agents, vitamin agents, non-steroidal anti-inflammatory agents, angiotensin converting enzyme inhibitor agents, polypeptides, proteins, nucleic acids, drugs, organic molecules and sleep inducers. In particular examples, the therapeutic agent is an antibody, an immunoglobulin, a bisphosphonate (such as zolentronic acid), a cytokine, a chemotherapeutic agent or an insulin (such as a fast-acting insulin).

Other therapeutic agents that can be included in the compositions provided herein include, but are not limited to, Acivicins; Aclarubicins; Acodazoles; Acronines; Adozelesins; Aldesleukins; Alemtuzumabs; Alitretinoins (9-Cis-Retinoic Acids); Allopurinols; Altretamines; Alvocidibs; Ambazones; Ambomycins; Ametantrones; Amifostines; Aminoglutethimides; Amsacrines; Anastrozoles; Anaxirones; Ancitabines; Anthramycins; Apaziquones; Argimesnas; Arsenic Trioxides; Asparaginases; Asperlins; Atrimustines; Azacitidines; Azetepas; Azotomycins; Banoxantrones; Batabulins; Batimastats; BCG Live; Benaxibines; Bendamustines; Benzodepas; Bexarotenes; Bevacizumab; Bicalutamides; Bietaserpines; Biricodars; Bisantrenes; Bisantrenes; Bisnafide Dimesylates; Bizelesins; Bleomycins; Bortezomibs; Brequinars; Bropirimines; Budotitanes; Busulfans; Cactinomycins; Calusterones; Canertinibs; Capecitabines; Caracemides; Carbetimers; Carboplatins; Carboquones; Carmofurs; Carmustines with Polifeprosans; Carmustines; Carubicins; Carzelesins; Cedefingols; Celecoxibs; Cemadotins; Chlorambucils; Cioteronels; Cirolemycins; Cisplatins; Cladribines; Clanfenurs; Clofarabines; Crisnatols; Cyclophosphamides; Cytarabine liposomals; Cytarabines; Dacarbazines; Dactinomycins; Darbepoetin Alfas; Daunorubicin liposomals; Daunorubicins/Daunomycins; Daunorubicins; Decitabines; Denileukin Diftitoxes; Dexniguldipines; Dexonnaplatins; Dexrazoxanes; Dezaguanines; Diaziquones; Dibrospidiums; Dienogests; Dinalins; Disermolides; Docetaxels; Dofequidars; Doxifluridines; Doxorubicin liposomals; Doxorubicin HCL; Docorubicin HCL liposome injection; Doxorubicins; Droloxifenes; Dromostanolone Propionates; Duazomycins; Ecomustines; Edatrexates; Edotecarins; Eflornithines; Elacridars; Elinafides; Elliott's B Solutions; Elsamitrucins; Emitefurs; Enloplatins; Enpromates; Enzastaurins; Epipropidines; Epirubicins; Epoetin alfas; Eptaloprosts; Erbulozoles; Esorubicins; Estramustines; Etanidazoles; Etoglucids; Etoposide phosphates; Etoposide VP-16s; Etoposides; Etoprines; Exemestanes; Exisulinds; Fadrozoles; Fazarabines; Fenretinides; Filgrastims; Floxuridines; Fludarabines; Fluorouracils; 5-fluorouracils; Fluoxymesterones; Fluorocitabines; Fosquidones; Fostriecins; Fostriecins; Fotretamines; Fulvestrants; Galarubicins; Galocitabines; Gemcitabines; Gemtuzumabs/Ozogamicins; Geroquinols; Gimatecans; Gimeracils; Gloxazones; Glufosfamides; Goserelin acetates; Hydroxyureas; Ibritumomabs/Tiuxetans; Idarubicins; Ifosfamides; Ilmofosines; Ilomastats; Imatinib mesylates; Imexons; Improsulfans; Indisulams; Inproquones; Interferon alfa-2 as; Interferon alfa-2bs; Interferon Alfas; Interferon Betas; Interferon Gammas; Interferons; Interleukin-2s and other Interleukins (including recombinant Interleukins); Intoplicines; Iobenguanes [131-I]; Iproplatins; Irinotecans; Irsogladines; Ixabepilones; Ketotrexates; L-Alanosines; Lanreotides; Lapatinibs; Ledoxantrones; Letrozoles; Leucovorins; Leuprolides; Leuprorelins (Leuprorelides); Levamisoles; Lexacalcitols; Liarozoles; Lobaplatins; Lometrexols; Lomustines/CCNUs; Lomustines; Lonafarnibs; Losoxantrones; Lurtotecans; Mafosfamides; Mannosulfans; Marimastats; Masoprocols; Maytansines; Mechlorethamines; Mechlorethamines/Nitrogen mustards; Megestrol acetates; Megestrols; Melengestrols; Melphalans; MelphalansIL-PAMs; Menogarils; Mepitiostanes; Mercaptopurines; 6-Mercaptopurine; Mesnas; Metesinds; Methotrexates; Methoxsalens; Metomidates; Metoprines; Meturedepas; Miboplatins; Miproxifenes; Misonidazoles; Mitindomides; Mitocarcins; Mitocromins; Mitoflaxones; Mitogillins; Mitoguazones; Mitomalcins; Mitomycin Cs; Mitomycins; Mitonafides; Mitoquidones; Mitospers; Mitotanes; Mitoxantrones; Mitozolomides; Mivobulins; Mizoribines; Mofarotenes; Mopidamols; Mubritinibs; Mycophenolic Acids; Nandrolone Phenpropionates; Nedaplatins; Nelzarabines; Nemorubicins; Nitracrines; Nocodazoles; Nofetumomabs; Nogalamycins; Nolatrexeds; Nortopixantrones; Octreotides; Oprelvekins; Ormaplatins; Ortataxels; Oteracils; Oxaliplatins; Oxisurans; Oxophenarsines; Paclitaxels; Pamidronates; Patubilones; Pegademases; Pegaspargases; Pegfilgrastims; Peldesines; Peliomycins; Pelitrexols; Pemetrexeds; Pentamustines; Pentostatins; Peplomycins; Perfosfamides; Perifosines; Picoplatins; Pinafides; Pipobromans; Piposulfans; Pirfenidones; Piroxantrones; Pixantrones; Plevitrexeds; Plicamycid Mithramycins; Plicamycins; Plomestanes; Plomestanes; Porfimer sodiums; Porfimers; Porfiromycins; Prednimustines; Procarbazines; Propamidines; Prospidiums; Pumitepas; Puromycins; Pyrazofurins; Quinacrines; Ranimustines; Rasburicases; Riboprines; Ritrosulfans; Rituximabs; Rogletimides; Roquinimexs; Rufocromomycins; Sabarubicins; Safingols; Sargramostims; Satraplatins; Sebriplatins; Semustines; Simtrazenes; Sizofurans; Sobuzoxanes; Sorafenibs; Sparfosates; Sparfosic Acids; Sparsomycins; Spirogermaniums; Spiromustines; Spiroplatins; Spiroplatins; Squalamines; Streptonigrins; Streptovarycins; Streptozocins; Sufosfamides; Sulofenurs; Sunitinib Malate; 6-TG; Tacedinalines; Talcs; Talisomycins; Tallimustines; Tamoxifens; Tariquidars; Tauromustines; Tecogalans; Tegafurs; Teloxantrones; Temoporfins; Temozolomides; Teniposides/VM-26s; Teniposides; Teroxirones; Testolactones; Thiamiprines; Thioguanines; Thiotepas; Tiamiprines; Tiazofurins; Tilomisoles; Tilorones; Timcodars; Timonacics; Tirapazamines; Topixantrones; Topotecans; Toremifenes; Tositumomabs; Trabectedins (Ecteinascidin 743); Trastuzumabs; Trestolones; Tretinoins/ATRA; Triciribines; Trilostanes; Trimetrexates; Triplatin Tetranitrates; Triptorelins; Trofosfamides; Tubulozoles; Ubenimexs; Uracil Mustards; Uredepas; Valrubicins; Valspodars; Vapreotides; Verteporfins; Vinblastines; Vincristines; Vindesines; Vinepidines; Vinflunines; Vinformides; Vinglycinates; Vinleucinols; Vinleurosines; Vinorelbines; Vinrosidines; Vintriptols; Vinzolidines; Vorozoles; Xanthomycin A's (Guamecyclines); Zeniplatins; Zilascorbs [2-H]; Zinostatins; Zoledronate; Zorubicins; and Zosuquidars.

Provided herein are methods for treating a hyaluronanassociated disease or condition, wherein a subject is administered an esPH20 or PH20, or a composition containing an esPH20 or PH20, provided and described herein. Also provided are methods for treating an excess of glycosaminoglycans; for treating a tumor; for treating glycosaminoglycan accumulation in the brain; for treating a cardiovascular disorder; for treating an ophthalmic disorder; for treating pulmonary disease; for increasing penetration of chemotherapeutic agents into solid tumors; for treating cellulite; or for increasing bioavailability of drugs and other therapeutic agents. Such methods involve administering to a subject any of the esPH20 or PH20 polypeptides or compositions described herein.

The esPH20 and PH20 polypeptides provided herein can be used in place of a PH20 hyaluronidase, alone or in combination, in any method of treatment or combination therapy for which a PH20 hyaluronidase is used in U.S. Publication Nos. US20040268425, US20050260186, and US20060104968; and U.S. application Ser. Nos. 12/381,844, 12/386,249, 12/387,225 and 12/386,222.

Any of the esPH20 or PH20 polypeptides provided herein can be substantially purified or isolated.

BRIEF DESCRIPTION OF THE FIGURES

FIG. 1 depicts an alignment of the amino acid sequence of the human (SEQ ID NO:107) and chimpanzee (SEQ ID NO:197) PH20 polypeptides (performed using the ClustalW2 alignment program). The amino acid residues of the human PH20 GPI-anchor attachment signal sequence, and the corresponding amino acids in the chimpanzee PH20 sequence, are in bold and underlined. "*" indicates that the residues above are identical in both sequences in the alignment. ":" indicates conserved substitutions, and "." indicates semi-conserved substitutions.

FIG. 3 depicts the endoglycosidase cleavage sites.

DETAILED DESCRIPTION

Figure 2:
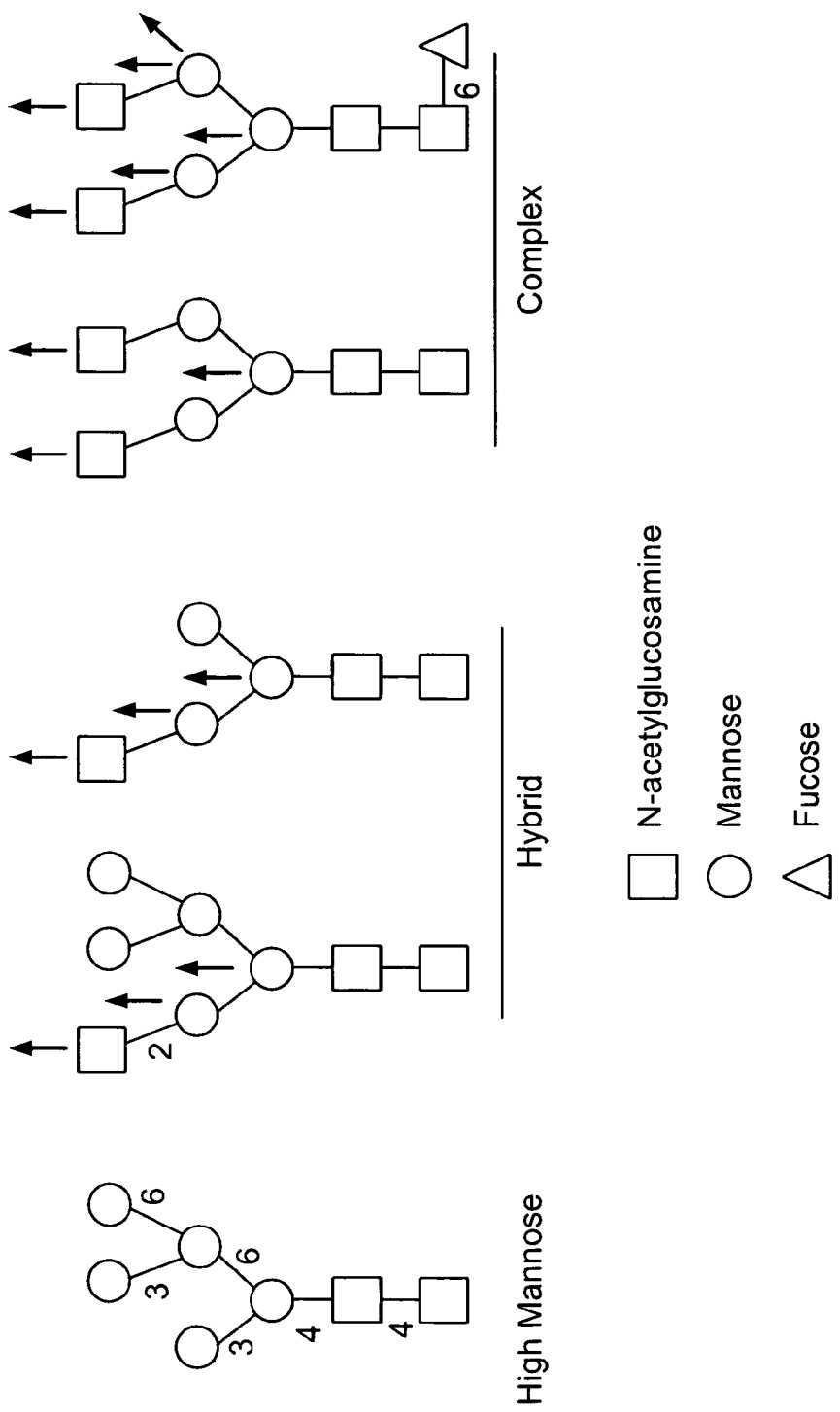
FIG. 2 depicts the major types of N-glycans in vertebrates, including high mannose glycans, hybrid glycans and complex glycans.
Figure 3A:
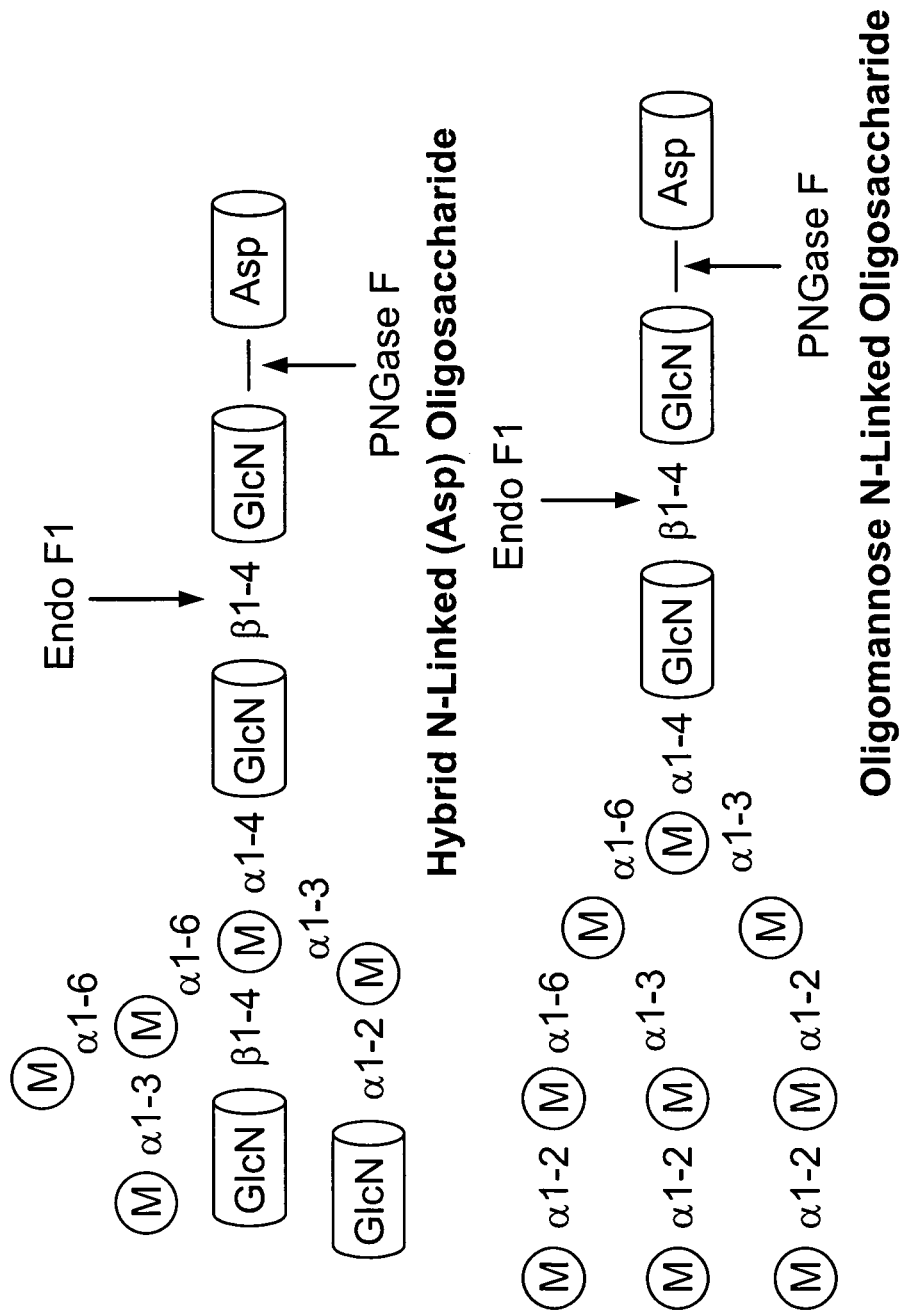
FIG. 3A illustrates the cleavage sites for Endoglycosidase F1 and Peptide N Glycosidase F (PNGaseF).
Figure 3B:
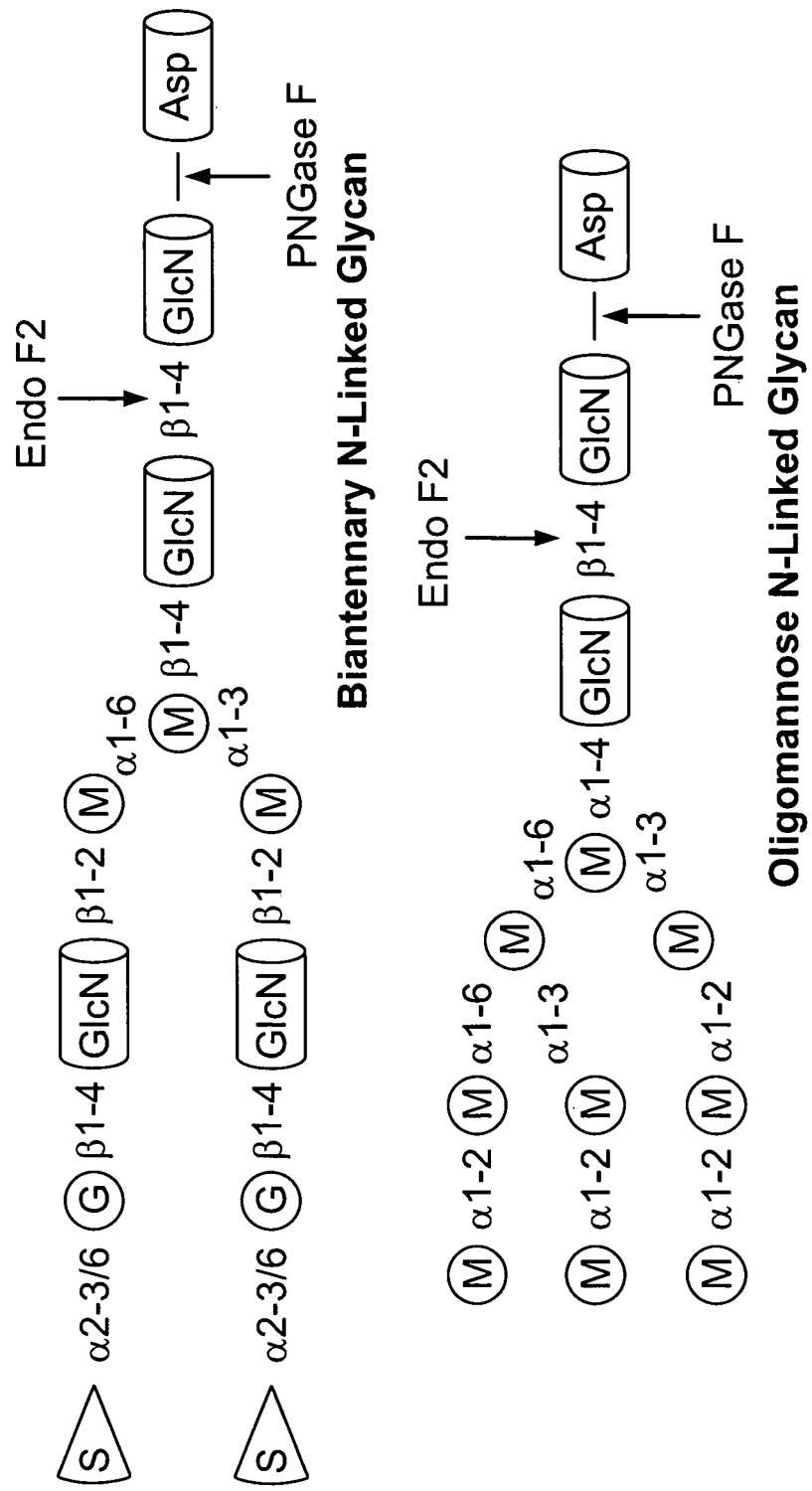
FIG. 3B illustrates the cleavage sites for Endoglycosidase F2 and PNGaseF.
Figure 3C:
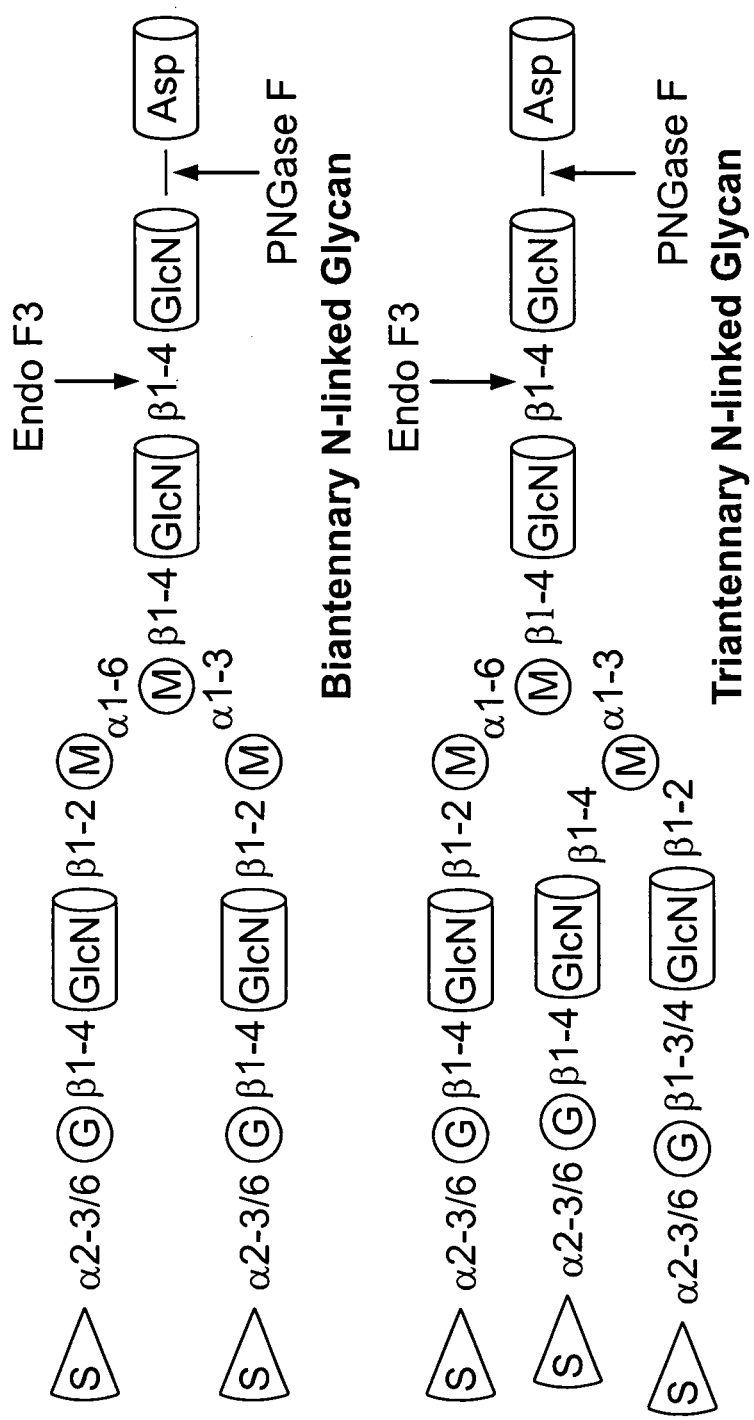
FIG. 3C illustrates the cleavage sites for Endoglycosidase F3 and PNGaseF.
Figure 3D:
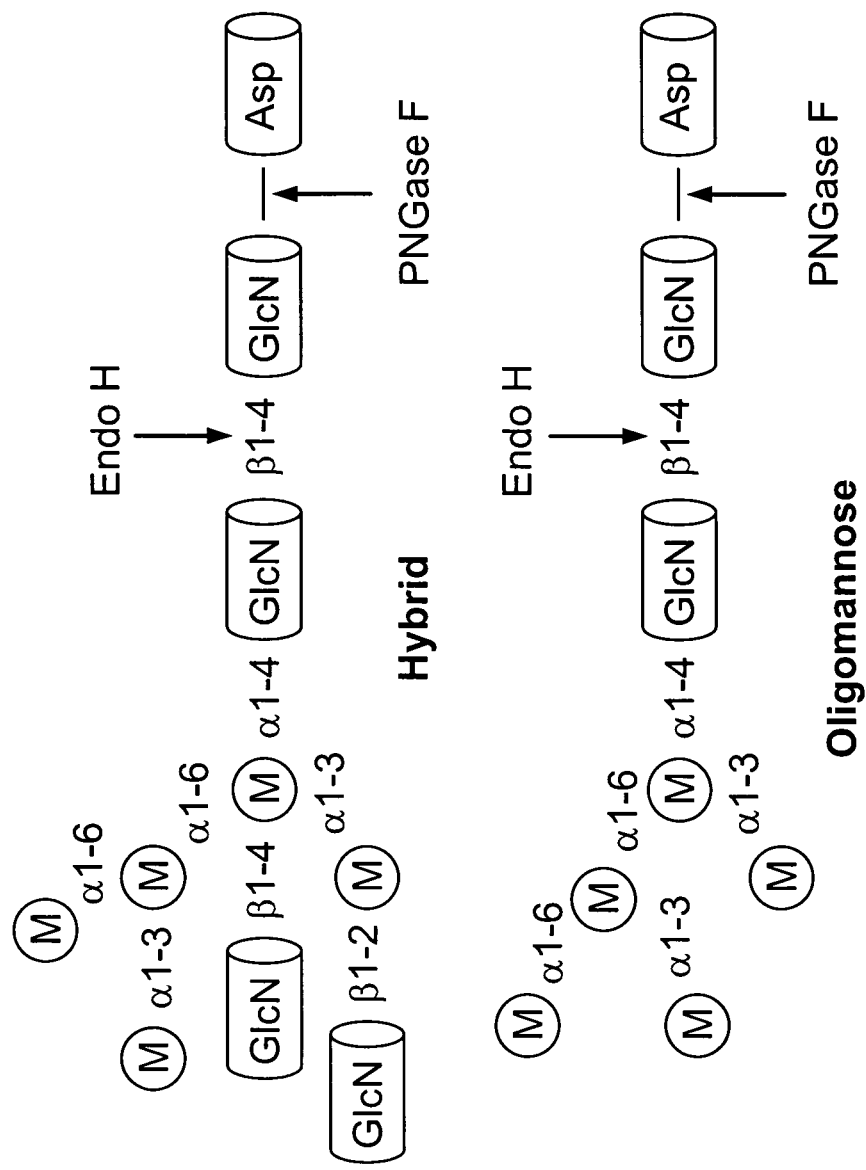
FIG. 3D illustrates the cleavage sites for Endoglycosidase F4 and PNGaseF.

| Overview |
|---|
| A. Definitions |
| B. Overview |
|    1. PH20 |
|       a. Glycosylation |
|       b. GPI-Anchoring |
| C. Extended Soluble PH20 Polypeptides |
|    1. Human esPH20 polypeptides |
|    2. Other species esPH20 polypeptides |
| D. N-Partially glycosylated PH20 polypeptides |
|    1. PH20 polypeptides |
|    2. C-terminally truncated PH20 polypeptides |
|    3. Additional Modifications |
|       Conjugation to polymers |
| E. Methods of Producing Nucleic Acids Encoding Extended Soluble PH20 and other Soluble PH20 Hyaluronidases, and Polypeptides Thereof |
|    1. Vectors and Cells |
|    2. Expression |
|       a. Prokaryotic Cells |
|       b. Yeast Cells |
|       c. Insect Cells |
|       d. Mammalian Cells |
|       e. Plants |
|    3. Purification Techniques |
| F. Preparation, Formulation and Administration of Extended Soluble PH20 Polypeptides, and Other Soluble PH20 Polypeptides |
|    1. Injectables, solutions and emulsions |
|       Lyophilized Powders |

-continued

| Overview |
|---|
| 2. Topical Administration<br>3. Compositions for other routes of administration<br>4. Dosage and Administration<br>5. Packaging, Articles of Manufacture and Kits<br>G. Assays<br>   1. Hyaluronidase Activity<br>   2. Solubility<br>H. Methods of Treatment and Uses of Extended Soluble PH20 and other Soluble PH20 and Combination Therapy<br>   1. Use as a Spreading Agent and Combination Therapy<br>   2. Use to Remove Excess Glycosaminoglycanases<br>      a. Use in cancer treatment<br>      b. Use in treatment of glycosaminoglycan accumulation in the brain<br>      c. Use in treatment of glycosaminoglycan accumulation in cardiovascular disease<br>      d. Use in vitrectomy and ophthalmic disorders and conditions<br>      e. Use in hypodermoclysis<br>      f. Use in gene therapy<br>      g. Cosmetic uses<br>      h. Use in organ transplantation<br>      i. Use in pulmonary disease<br>   3. Other uses<br>I. Examples |

A. Definitions

Unless defined otherwise, all technical and scientific terms used herein have the same meaning as is commonly understood by one of skill in the art to which the invention(s) belong. All patents, patent applications, published applications and publications, Genbank sequences, databases, websites and other published materials referred to throughout the entire disclosure herein, unless noted otherwise, are incorporated by reference in their entirety. In the event that there are a plurality of definitions for terms herein, those in this section prevail. Where reference is made to a URL or other such identifier or address, it understood that such identifiers can change and particular information on the internet can come and go, but equivalent information can be found by searching the Internet. Reference thereto evidences the availability and public dissemination of such information.

As used herein, hyaluronidase refers to a class of enzymes that degrade hyaluronan. Hyaluronidases include, but are not limited to, bacterial hyaluronidases (EC 4.2.2.1 or EC 4.2.99.1), hyaluronidases from leeches, other parasites, and crustaceans (EC 3.2.1.36), and mammalian-type hyaluronidases (EC 3.2.1.35). Hyaluronidases include any of non-human origin including, but not limited to, murine, canine, feline, leporine, avian, bovine, ovine, porcine, equine, piscine, ranine, bacterial, and any from leeches, other parasites, and crustaceans. Exemplary human hyaluronidases include HYAL1, HYAL2, HYAL3, HYAL4, and PH20 (SEQ ID NO:107). Also included amongst hyaluronidases are soluble hyaluronidases, including, ovine and bovine PH20, soluble human PH20 and rHuPH20. Examples of commercially available bovine or ovine soluble hyaluronidases are Vitrase® hyaluronidase (ovine hyaluronidase) and Amphadase® hyaluronidase (bovine hyaluronidase).

As used herein, PH20 refers to a type of hyaluronidase that occurs in sperm and is neutral-active. PH-20 occurs on the sperm surface, and in the lysosome-derived acrosome, where it is bound to the inner acrosomal membrane. PH20 includes those of any origin including, but not limited to, human, chimpanzee, Cynomolgus monkey, Rhesus monkey, murine, bovine, ovine, guinea pig, rabbit and rat origin. Exemplary PH20 polypeptides include those from human (SEQ ID NO:107), chimpanzee (SEQ ID NO:197), Rhesus monkey (SEQ ID NO:198), Cynomolgus monkey (SEQ ID NO:114), cow (e.g., SEQ ID NOS:111 and 119); mouse (SEQ ID NO:117); rat (SEQ ID NOS:116 NO:116); rabbit (SEQ ID NO:112); sheep (SEQ ID NOS:113, 118 and 120) and guinea pig (SEQ ID NO:115). Reference to PH20 includes precursor PH20 polypeptides and mature PH20 polypeptides (such as those in which a signal sequence has been removed), truncated forms thereof that have activity, and includes allelic variants and species variants, variants encoded by splice variants, and other variants, including polypeptides that have at least 40%, 45%, 50%, 55%, 65%, 70%, 75%, 80%, 85%, 90%, 95%, 96%, 97%, 98%, 99% or more sequence identity to the precursor polypeptides set forth in SEQ ID NO:107 and 109, or the mature forms thereof. PH20 polypeptides also include those that contain chemical or posttranslational modifications and those that do not contain chemical or posttranslational modifications. Such modifications include, but are not limited to, pegylation, albumination, glycosylation, farnysylation, carboxylation, hydroxylation, phosphorylation, and other polypeptide modifications known in the art. A truncated PH20 hyaluronidase is any C-terminal shortened form thereof, particularly forms that are truncated and neutral active when N-glycosylated.

As used herein, a soluble PH20 refers to any form of PH20 that is soluble under physiologic conditions. A soluble PH20 can be identified, for example, by its partitioning into the aqueous phase of a Triton® X-114 solution at 37° C. (Bordier et al., (1981) J. Biol. Chem., 256:1604-7). Membrane-anchored PH20, such as lipid-anchored PH20, including GPI-anchored PH20, will partition into the detergent-rich phase, but will partition into the detergent-poor or aqueous phase following treatment with Phospholipase-C. Included among soluble PH20 are membrane-anchored PH20 in which one or more regions associated with anchoring of the PH20 to the membrane has been removed or modified, where the soluble form retains hyaluronidase activity. Soluble PH20 also include recombinant soluble PH20 and those contained in or purified from natural sources, such as, for example, testes extracts from sheep or cows. Exemplary of such soluble PH20 is soluble human PH20.

As used herein, soluble human PH20 or sHuPH20 includes PH20 polypeptides lacking all or a portion of the glycosylphospatidylinositol (GPI) anchor sequence at the C-terminus such that upon expression, the polypeptides are soluble under physiological conditions. Solubility can be assessed by any suitable method that demonstrates solubility under physiologic conditions. Exemplary of such methods is the Triton® X-114 assay, that assesses partitioning into the aqueous phase and that is described above and in the examples. In addition, a soluble human PH20 polypeptide is, if produced in CHO cells, such as CHO—S cells, a polypeptide that is expressed and is secreted into the cell culture medium. Soluble human PH20 polypeptides, however, are not limited to those produced in CHO cells, but can be produced in any cell or by any method, including recombinant expression and polypeptide synthesis. Reference to secretion in CHO cells is definitional. Hence, if a polypeptide could be expressed and secreted in CHO cells and is soluble, i.e. partitions into the aqueous phase when extracted with Triton® X-114, it is a soluble PH20 polypeptide whether or not it is so-produced. The precursor polypeptides for sHuPH20 polypeptides can include a signal sequence, such as a heterologous or non-heterologous (i.e. native) signal sequence. Exemplary of the precursors are those that include a signal sequence, such as the native 35 amino acid signal sequence at amino acid positions 1-35 (see, e.g., amino acids 1-35 of SEQ ID NO:107).

As used herein, an "extended soluble PH20" or "esPH20" includes soluble PH20 polypeptides that contain residues up to the GPI anchor-attachment signal sequence and one or more contiguous residues from the GPI-anchor attachment signal sequence such that the esPH20 is soluble under physiological conditions. Solubility under physiological conditions can be determined by any method known to those of skill in the art. For example, it can be assessed by the Triton® X-114 assay described above and in the examples. In addition, as discussed above, a soluble PH20 is, if produced in CHO cells, such as CHO—S cells, a polypeptide that is expressed and is secreted into the cell culture medium. Soluble human PH20 polypeptides, however, are not limited to those produced in CHO cells, but can be produced in any cell or by any method, including recombinant expression and polypeptide synthesis. Reference to secretion in CHO cells is definitional. Hence, if a polypeptide could be expressed and secreted in CHO cells and is soluble, i.e. partitions into the aqueous phase when extracted with Triton® X-114, it is a soluble PH20 polypeptide whether or not it is so-produced. Human soluble esPH20 polypeptides include, in addition to residues 36-490, one or more contiguous amino acids from amino acid residue position 491 of SEQ ID NO:107, inclusive, such that the resulting polypeptide is soluble. Exemplary human esPH20 soluble polypeptides are those that have amino acids residues corresponding to amino acids 36-491, 36-492, 36-493, 36-494, 36-495, 36-496 and 36-497 of SEQ ID NO:107. Exemplary of these are those with an amino acid sequence set forth in any of SEQ ID NOS:60-63 and 102-104. Also included are allelic variants and other variants, such as any with 40%, 45%, 50%, 55%, 65%, 70%, 75%, 80%, 85%, 90%, 91%, 92%, 93%, 94%, 95%, 96%, 97%, 98%, 99% or greater sequence identity with the corresponding polypeptides of SEQ ID NOS: 60-63 and 102-104 that retain neutral activity and are soluble. Reference to sequence identity refers to variants with amino acid substitutions.

As used herein, reference to esPH20s includes precursor esPH20 polypeptides and mature esPH20 polypeptides (such as those in which a signal sequence has been removed), truncated forms thereof that have enzymatic activity (retaining at least 1%, 10%, 20%, 30%, 40%, 50% or more of the full-length form) and are soluble, and includes allelic variants and species variants, variants encoded by splice variants, and other variants, including polypeptides that have at least 40%, 45%, 50%, 55%, 65%, 70%, 75%, 80%, 85%, 90%, 91%, 92%, 93%, 94%, 95%, 96%, 97%, 98%, 99% or more sequence identity to the precursor polypeptides set forth in SEQ ID NOS:107 and 109, or the mature forms thereof.

As used herein, reference to esPH20s also include those that contain chemical or posttranslational modifications and those that do not contain chemical or posttranslational modifications. Such modifications include, but are not limited to, PEGylation, albumination, glycosylation, farnesylation, carboxylation, hydroxylation, phosphorylation, and other polypeptide modifications known in the art.

As used herein, soluble recombinant human PH20 (rHuPH20) refers to a soluble form of human PH20 that as recombinantly expressed and secreted in Chinese Hamster Ovary (CHO) cells. Soluble rHuPH20 is encoded by nucleic acid that includes the signal sequence and is set forth in SEQ ID NO:109. Also included are DNA molecules that are allelic variants thereof and other soluble variants. The nucleic acid encoding soluble rHuPH20 is expressed in CHO cells which secrete the mature polypeptide. As produced in the culture medium, there is heterogeneity at the C-terminus so that the product includes a mixture of species that can include any one or more of SEQ ID NO:122 to SEQ ID NO:127 in various abundance.

Similarly, for other forms of PH20, such as the esPH20s, recombinantly expressed polypeptides and compositions thereof can include a plurality of species whose C-terminus exhibits heterogeneity. For example, compositions of recombinantly expressed esPH20 produced by expression of the polypeptide of SEQ ID NO:8, which encodes an esPH20 that has amino acids 36-497, can include forms with fewer amino acids, such as 36-496, 36-495.

As used herein, an N-linked moiety refers to an asparagine (N) amino acid residue of a polypeptide that is capable of being glycosylated by post-translational modification of a polypeptide. Exemplary N-linked moieties of human PH20 include amino acids N82, N166, N235, N254, N368 and N393 of human PH20 set forth in SEQ ID NO:107.

As used herein, an N-glycosylated polypeptide refers to a PH20 polypeptide or truncated form thereof containing oligosaccharide linkage of at least three N-linked amino acid residues, for example, N-linked moieties corresponding to amino acid residues N235, N368 and N393 of SEQ ID NO:107. An N-glycosylated polypeptide can include a polypeptide where three, four, five and up to all of the N-linked moieties are linked to an oligosaccharide. The N-linked oligosaccharides can include oligomannose, complex, hybrid or sulfated oligosaccharides, or other oligosaccharides and monosaccharides.

As used herein, an N-partially glycosylated polypeptide refers to a polypeptide that minimally contains an N-acetylglucosamine glycan linked to at least three N-linked moieties. A partially glycosylated polypeptide can include various glycan forms, including monosaccharides, oligosaccharides, and branched sugar forms, including those formed by treatment of a polypeptide with EndoH, EndoF1, EndoF2 and/or EndoF3. The cleavage of glycans by such enzymes is depicted, for example, in FIG. 2.

As used herein, a deglycosylated PH20 polypeptide refers to a PH20 polypeptide provided herein in which fewer than all possible glycosylation sites are glycosylated. Deglycosylation can be effected, for example, by removing glycosylation, by preventing it, or by modifying the polypeptide to eliminate a glycosylation site. As shown herein, particular N-glycosylation sites are not required for activity, whereas others are.

As used herein, a hyaluronan-associated disease, disorder or condition refers to any disease or condition in which hyaluronan levels are elevated as cause, consequence or otherwise observed in the disease or condition. Hyaluronan-associated diseases and conditions are associated with elevated hyaluronan expression in a tissue or cell, increased interstitial fluid pressure, decreased vascular volume, and/or increased water content in a tissue. Hyaluronan-associated diseases, disorders or conditions can be treated by administration of a composition containing a hyaluronan degrading enzyme, such as a hyaluronidase, for example, a soluble hyaluronidase, either alone or in combination with or in addition to another treatment and/or agent. Exemplary diseases and conditions, include, but are not limited to, hyaluronan-rich cancers, for example, tumors, including solid tumors such as late-stage cancers, a metastatic cancers, undifferentiated cancers, ovarian cancer, in situ carcinoma (ISC), squamous cell carcinoma (SCC), prostate cancer, pancreatic cancer, non-small cell lung cancer, breast cancer, colon cancer and other cancers. Also exemplary of hyaluronan-associated diseases and conditions are diseases that are associated with elevated interstitial fluid pressure, such as diseases associated with disc pressure, and edema, for example, edema caused by organ transplant, stroke, brain trauma or other injury. Exemplary hyaluronan-associated diseases and conditions include diseases and conditions associated with elevated interstitial fluid pressure, decreased vascular volume, and/or increased water content in a tissue, including cancers, disc pressure and edema. In one example, treatment of the hyaluronan-associated condition, disease or disorder includes amelioration, reduction, or other beneficial effect on one or more of increased interstitial fluid pressure (IFP), decreased vascular volume, and increased water content in a tissue.

As used herein, a conjugate refers to soluble PH20 polypeptides linked directly or indirectly to one or more other polypeptides or chemical moieties. Such conjugates include fusion proteins, those produced by chemical conjugates and those produced by any other method whereby at least one soluble PH20 polypeptide is linked, directly or indirectly to another polypeptide or chemical moiety so long as the conjugate retains hyaluronidase activity. Exemplary of conjugates provided herein include PH20 polypeptides linked directly or indirectly to a multimerization domain, such as an Fc moiety, a toxin, a label or a drug.

As used herein, a fusion protein refers to a polypeptide encoded by a nucleic acid sequence containing a coding sequence from one nucleic acid molecule and the coding sequence from another nucleic acid molecule in which the coding sequences are in the same reading frame such that when the fusion construct is transcribed and translated in a host cell, the protein is produced containing the two proteins. The two molecules can be adjacent in the construct or separated by a linker polypeptide that contains, 1, 2, 3, or more, but typically fewer than 10, 9, 8, 7, or 6 amino acids. The protein product encoded by a fusion construct is referred to as a fusion polypeptide. Exemplary of fusion polypeptides include Fc fusions.

As used herein, a polymer that is conjugated to a hyaluronan degrading enzyme, such as a hyaluronidase, refers to any polymer that is covalently or otherwise stably linked, directly or via a linker, to a hyaluronan degrading enzyme. Such polymers, typically increase serum half-life, and include, but are not limited to sialic moieties, pegylation moieties, dextran, and sugar and other moieties, such as for glycosylation.

As used herein, activity refers to a functional activity or activities of a polypeptide or portion thereof associated with a full-length (complete) protein. Functional activities include, but are not limited to, biological activity, catalytic or enzymatic activity, antigenicity (ability to bind or compete with a polypeptide for binding to an anti-polypeptide antibody), immunogenicity, ability to form multimers, and the ability to specifically bind to a receptor or ligand for the polypeptide.

As used herein, hyaluronidase activity refers to the ability to enzymatically catalyze the cleavage of hyaluronic acid. The United States Pharmacopeia (USP) XXII assay for hyaluronidase determines hyaluronidase activity indirectly by measuring the amount of higher molecular weight hyaluronic acid, or hyaluronan, (HA) substrate remaining after the enzyme is allowed to react with the HA for 30 min at 37° C. (USP XXII-NF XVII (1990) 644-645 United States Pharmacopeia Convention, Inc, Rockville, Md.). A Reference Standard solution can be used in an assay to ascertain the relative activity, in units, of any hyaluronidase. In vitro assays to determine the hyaluronidase activity of hyaluronidases, such as PH20, including soluble PH20 and esPH20, are known in the art and described herein. Exemplary assays include the microturbidity assay described below (see e.g. Example 12) that measures cleavage of hyaluronic acid by hyaluronidase indirectly by detecting the insoluble precipitate formed when the uncleaved hyaluronic acid binds with serum albumin. Reference Standards can be used, for example, to generate a standard curve to determine the activity in Units of the hyaluronidase being tested.

As used herein, neutral active refers to the ability of a PH20 polypeptide to enzymatically catalyze the cleavage of hyaluronic acid at neutral pH. A neutral active C-terminally truncated or N-partially glycosylated PH20 provided herein has or has about 30%, 40%, 50%, 60%, 70%, 80%, 90%, 91%, 92%, 93%, 94%, 95%, 96%, 97%, 98%, 99%, 100%, 110%, 120%, 130%, 140%, 150%, 200%, 300%, 400%, 500%, 1000% or more activity compared to the hyaluronidase activity of a corresponding neutral active PH20 that is not C-terminally truncated or N-partially glycosylated.

As used herein, a GPI-anchor attachment signal sequence is a C-terminal sequence of amino acids that directs addition of a preformed GPI-anchor to the polypeptide within the lumen of the ER. GPI-anchor attachment signal sequences are present in the precursor polypeptides of GPI-anchored polypeptides, such as GPI-anchored PH20 polypeptides. The C-terminal GPI-anchor attachment signal sequence typically contains a predominantly hydrophobic region of 8-20 amino acids, preceded by a hydrophilic spacer region of 8-12 amino acids, immediately downstream of the ω-site, or site of GPI-anchor attachment. GPI-anchor attachment signal sequences can be identified using methods well known in the art. These include, but are not limited to, in silico methods and algorithms (see, e.g. Udenfriend et al. (1995) *Methods Enzymol.* 250:571-582, Eisenhaber et al., (1999) *J. Biol. Chem.* 292: 741-758, Kronegg and Buloz, (1999), "Detection/prediction of GPI cleavage site (GPI-anchor) in a protein (DGPI)", e.g., the website 129.194.185.165/dgpi/, Fankhauser et al., (2005) *Bioinformatics* 21:1846-1852, Omaetxebarria et al., (2007) *Proteomics* 7:1951-1960, Pierleoni et al., (2008) BMC Bioinformatics 9:392), including those that are readily available on bioinformatic websites, such as the ExPASy Proteomics tools site (e.g., the WorldWideWeb site expasy.ch/tools/).

As used herein, a bifucosylated polypeptide refers to a polypeptide that has two fucose residues, one with a α1,3-linkage and the other with α1,6-linkage, linked to the same core N-acetylglucosamine moiety, with the N-acetylglucosamine moiety linked to the asparagine residue in the polypeptide chain. Bifucosylated polypeptides generally are produced in insect cells.

As used herein, nucleic acids include DNA, RNA and analogs thereof, including peptide nucleic acids (PNA) and mixtures thereof. Nucleic acids can be single or double-stranded. When referring to probes or primers, which are optionally labeled, such as with a detectable label, such as a fluorescent or radiolabel, single-stranded molecules are contemplated. Such molecules are typically of a length such that their target is statistically unique or of low copy number (typically less than 5, generally less than 3) for probing or priming a library. Generally a probe or primer contains at least 14, 16 or 30 contiguous nucleotides of sequence complementary to or identical to a gene of interest. Probes and primers can be 10, 20, 30, 50, 100 or more nucleic acids long.

As used herein, a peptide refers to a polypeptide that is greater than or equal to 2 amino acids in length, and less than or equal to 40 amino acids in length. As used herein, the amino acids which occur in the various sequences of amino acids provided herein are identified according to their known, three-letter or one-letter abbreviations (Table 1). The nucleotides which occur in the various nucleic acid fragments are designated with the standard single-letter designations used routinely in the art.

As used herein, an "amino acid" is an organic compound containing an amino group and a carboxylic acid group. A polypeptide contains two or more amino acids. For purposes herein, amino acids include the twenty naturally-occurring amino acids, non-natural amino acids and amino acid analogs (i.e., amino acids wherein the α-carbon has a side chain).

As used herein, "amino acid residue" refers to an amino acid formed upon chemical digestion (hydrolysis) of a polypeptide at its peptide linkages. The amino acid residues described herein are presumed to be in the "L" isomeric form. Residues in the "D" isomeric form, which are so designated, can be substituted for any L-amino acid residue as long as the desired functional property is retained by the polypeptide. NH2 refers to the free amino group present at the amino terminus of a polypeptide. COOH refers to the free carboxy group present at the carboxyl terminus of a polypeptide. In keeping with standard polypeptide nomenclature described in J. Biol. Chem., 243: 3557-3559 (1968), and adopted 37 C.F.R. §§1.821-1.822, abbreviations for amino acid residues are shown in Table 1:

TABLE 1

Table of Correspondence

| SYMBOL | | |
|---|---|---|
| 1-Letter | 3-Letter | AMINO ACID |
| Y | Tyr | Tyrosine |
| G | Gly | Glycine |
| F | Phe | Phenylalanine |
| M | Met | Methionine |
| A | Ala | Alanine |
| S | Ser | Serine |
| I | Ile | Isoleucine |
| L | Leu | Leucine |
| T | Thr | Threonine |
| V | Val | Valine |
| P | Pro | Proline |
| K | Lys | Lysine |
| H | His | Histidine |
| Q | Gln | Glutamine |
| E | Glu | Glutamic acid |
| Z | Glx | Glu and/or Gln |
| W | Trp | Tryptophan |
| R | Arg | Arginine |
| D | Asp | Aspartic acid |
| N | Asn | Asparagine |
| B | Asx | Asn and/or Asp |
| C | Cys | Cysteine |
| X | Xaa | Unknown or other |

All amino acid residue sequences represented herein by formulae have a left to right orientation in the conventional direction of amino-terminus to carboxyl-terminus. In addition, the phrase "amino acid residue" is defined to include the amino acids listed in the Table of Correspondence (Table 1) and modified and unusual amino acids, such as those referred to in 37 C.F.R. §§1.821-1.822, and incorporated herein by reference. Furthermore, it should be noted that a dash at the beginning or end of an amino acid residue sequence indicates a peptide bond to a further sequence of one or more amino acid residues, to an amino-terminal group such as NH2 or to a carboxyl-terminal group such as COOH.

As used herein, the "naturally occurring α-amino acids" are the residues of those 20 α-amino acids found in nature which are incorporated into protein by the specific recognition of the charged tRNA molecule with its cognate mRNA codon in humans. Non-naturally occurring amino acids thus include, for example, amino acids or analogs of amino acids other than the 20 naturally-occurring amino acids and include, but are not limited to, the D-isostereomers of amino acids. Exemplary non-natural amino acids are described herein and are known to those of skill in the art.

As used herein, a DNA construct is a single- or double-stranded, linear or circular DNA molecule that contains segments of DNA combined and juxtaposed in a manner not found in nature. DNA constructs exist as a result of human manipulation, and include clones and other copies of manipulated molecules.

As used herein, a DNA segment is a portion of a larger DNA molecule having specified attributes. For example, a DNA segment encoding a specified polypeptide is a portion of a longer DNA molecule, such as a plasmid or plasmid fragment, which, when read from the 5' to 3' direction, encodes the sequence of amino acids of the specified polypeptide.

As used herein, the term polynucleotide means a single- or double-stranded polymer of deoxyribonucleotides or ribonucleotide bases read from the 5' to the 3' end. Polynucleotides include RNA and DNA, and can be isolated from natural sources, synthesized in vitro, or prepared from a combination of natural and synthetic molecules. The length of a polynucleotide molecule is given herein in terms of nucleotides (abbreviated "nt") or base pairs (abbreviated "bp"). The term nucleotides is used for single- and double-stranded molecules where the context permits. When the term is applied to double-stranded molecules it is used to denote overall length and will be understood to be equivalent to the term base pairs. It will be recognized by those skilled in the art that the two strands of a double-stranded polynucleotide can differ slightly in length and that the ends thereof can be staggered; thus all nucleotides within a double-stranded polynucleotide molecule may not be paired. Such unpaired ends will, in general, not exceed 20 nucleotides in length.

As used herein, "similarity" between two proteins or nucleic acids refers to the relatedness between the sequence of amino acids of the proteins or the nucleotide sequences of the nucleic acids. Similarity can be based on the degree of identity and/or homology of sequences of residues and the residues contained therein. Methods for assessing the degree of similarity between proteins or nucleic acids are known to those of skill in the art. For example, in one method of assessing sequence similarity, two amino acid or nucleotide sequences are aligned in a manner that yields a maximal level of identity between the sequences. "Identity" refers to the extent to which the amino acid or nucleotide sequences are invariant. Alignment of amino acid sequences, and to some extent nucleotide sequences, also can take into account conservative differences and/or frequent substitutions in amino acids (or nucleotides). Conservative differences are those that preserve the physico-chemical properties of the residues involved. Alignments can be global (alignment of the compared sequences over the entire length of the sequences and including all residues) or local (the alignment of a portion of the sequences that includes only the most similar region or regions).

"Identity" per se has an art-recognized meaning and can be calculated using published techniques. (See, e.g. Computational Molecular Biology, Lesk, A. M., ed., Oxford University Press, New York, 1988; Biocomputing: Informatics and Genome Projects, Smith, D. W., ed., Academic Press, New York, 1993; Computer Analysis of Sequence Data, Part I, Griffin, A. M., and Griffin, H. G., eds., Humana Press, New Jersey, 1994; Sequence Analysis in Molecular Biology, von Heinje, G., Academic Press, 1987; and Sequence Analysis Primer, Gribskov, M. and Devereux, J., eds., M Stockton Press, New York, 1991). While there exists a number of methods to measure identity between two polynucleotide or polypeptides, the term "identity" is well known to skilled artisans (Carillo, H. & Lipton, D., SIAM J Applied Math 48:1073 (1988)).

As used herein, homologous (with respect to nucleic acid and/or amino acid sequences) means about greater than or equal to 25% sequence homology, typically greater than or equal to 25%, 40%, 50%, 60%, 70%, 80%, 85%, 90% or 95% sequence homology; the precise percentage can be specified if necessary. For purposes herein the terms "homology" and "identity" are often used interchangeably, unless otherwise indicated. In general, for determination of the percentage homology or identity, sequences are aligned so that the highest order match is obtained (see, e.g.: Computational Molecular Biology, Lesk, A. M., ed., Oxford University Press, New York, 1988; Biocomputing: Informatics and Genome Projects, Smith, D. W., ed., Academic Press, New York, 1993; Computer Analysis of Sequence Data, Part I, Griffin, A. M., and Griffin, H. G., eds., Humana Press, New Jersey, 1994; Sequence Analysis in Molecular Biology, von Heinje, G., Academic Press, 1987; and Sequence Analysis Primer, Gribskov, M. and Devereux, J., eds., M Stockton Press, New York, 1991; Carillo et al. (1988) SIAM J Applied Math 48:1073). By sequence homology, the number of conserved amino acids is determined by standard alignment algorithms programs, and can be used with default gap penalties established by each supplier. Substantially homologous nucleic acid molecules would hybridize typically at moderate stringency or at high stringency all along the length of the nucleic acid of interest. Also contemplated are nucleic acid molecules that contain degenerate codons in place of codons in the hybridizing nucleic acid molecule.

Whether any two molecules have nucleotide sequences or amino acid sequences that are at least 60%, 70%, 80%, 85%, 90%, 95%, 96%, 97%, 98% or 99% "identical" or "homologous" can be determined using known computer algorithms such as the "FASTA" program, using for example, the default parameters as in Pearson et al. (1988) *Proc. Natl. Acad. Sci. USA* 85:2444 (other programs include the GCG program package (Devereux, J., et al., *Nucleic Acids Research* 12 (I):387 (1984)), BLASTP, BLASTN, FASTA (Atschul, S. F., et al., *J Mol Biol* 215:403 (1990)); Guide to Huge Computers, Martin J. Bishop, ed., Academic Press, San Diego, 1994, and Carillo et al. (1988) *SIAM J Applied Math* 48:1073). For example, the BLAST function of the National Center for Biotechnology Information database can be used to determine identity. Other commercially or publicly available programs include, DNAStar "MegAlign" program (Madison, Wis.) and the University of Wisconsin Genetics Computer Group (UWG) "Gap" program (Madison Wis.). Percent homology or identity of proteins and/or nucleic acid molecules can be determined, for example, by comparing sequence information using a GAP computer program (e.g., Needleman et al. (1970) J. Mol. Biol. 48:443, as revised by Smith and Waterman ((1981) Adv. Appl. Math. 2:482). Briefly, the GAP program defines similarity as the number of aligned symbols (i.e., nucleotides or amino acids), which are similar, divided by the total number of symbols in the shorter of the two sequences. Default parameters for the GAP program can include: (1) a unary comparison matrix (containing a value of 1 for identities and 0 for non-identities) and the weighted comparison matrix of Gribskov et al. (1986) *Nucl. Acids Res.* 14:6745, as described by Schwartz and Dayhoff, eds., ATLAS OF PROTEIN SEQUENCE AND STRUCTURE, National Biomedical Research Foundation, pp. 353-358 (1979); (2) a penalty of 3.0 for each gap and an additional 0.10 penalty for each symbol in each gap; and (3) no penalty for end gaps.

Therefore, as used herein, the term "identity" or "homology" represents a comparison between a test and a reference polypeptide or polynucleotide. As used herein, the term at least "90% identical to" refers to percent identities from 90 to 99.99 relative to the reference nucleic acid or amino acid sequence of the polypeptide. Identity at a level of 90% or more is indicative of the fact that, assuming for exemplification purposes a test and reference polypeptide length of 100 amino acids are compared. No more than 10% (i.e., 10 out of 100) of the amino acids in the test polypeptide differs from that of the reference polypeptide. Similar comparisons can be made between test and reference polynucleotides. Such differences can be represented as point mutations randomly distributed over the entire length of a polypeptide or they can be clustered in one or more locations of varying length up to the maximum allowable, e.g. 10/100 amino acid difference (approximately 90% identity). Differences are defined as nucleic acid or amino acid substitutions, insertions or deletions. At the level of homologies or identities above about 85-90%, the result should be independent of the program and gap parameters set; such high levels of identity can be assessed readily, often by manual alignment without relying on software.

As used herein, an aligned sequence refers to the use of homology (similarity and/or identity) to align corresponding positions in a sequence of nucleotides or amino acids. Typically, two or more sequences that are related by 50% or more identity are aligned. An aligned set of sequences refers to 2 or more sequences that are aligned at corresponding positions and can include aligning sequences derived from RNAs, such as ESTs and other cDNAs, aligned with genomic DNA sequence.

As used herein, "primer" refers to a nucleic acid molecule that can act as a point of initiation of template-directed DNA synthesis under appropriate conditions (e.g., in the presence of four different nucleoside triphosphates and a polymerization agent, such as DNA polymerase, RNA polymerase or reverse transcriptase) in an appropriate buffer and at a suitable temperature. It will be appreciated that a certain nucleic acid molecules can serve as a "probe" and as a "primer." A primer, however, has a 3' hydroxyl group for extension. A primer can be used in a variety of methods, including, for example, polymerase chain reaction (PCR), reverse-transcriptase (RT)-PCR, RNA PCR, LCR, multiplex PCR, panhandle PCR, capture PCR, expression PCR, 3' and 5' RACE, in situ PCR, ligation-mediated PCR and other amplification protocols.

As used herein, "primer pair" refers to a set of primers that includes a 5' (upstream) primer that hybridizes with the 5' end of a sequence to be amplified (e.g. by PCR) and a 3' (downstream) primer that hybridizes with the complement of the 3' end of the sequence to be amplified.

As used herein, "specifically hybridizes" refers to annealing, by complementary base-pairing, of a nucleic acid molecule (e.g. an oligonucleotide) to a target nucleic acid molecule. Those of skill in the art are familiar with in vitro and in vivo parameters that affect specific hybridization, such as length and composition of the particular molecule. Parameters particularly relevant to in vitro hybridization further include annealing and washing temperature, buffer composition and salt concentration. Exemplary washing conditions for removing non-specifically bound nucleic acid molecules at high stringency are 0.1×SSPE, 0.1% SDS, 65° C., and at medium stringency are 0.2×SSPE, 0.1% SDS, 50° C. Equivalent stringency conditions are known in the art. The skilled person can readily adjust these parameters to achieve specific hybridization of a nucleic acid molecule to a target nucleic acid molecule appropriate for a particular application. Complementary, when referring to two nucleotide sequences, means that the two sequences of nucleotides are capable of hybridizing, typically with less than 25%, 15% or 5% mismatches between opposed nucleotides. If necessary, the percentage of complementarity will be specified. Typically the two molecules are selected such that they will hybridize under conditions of high stringency.

As used herein, substantially identical to a product means sufficiently similar so that the property of interest is sufficiently unchanged so that the substantially identical product can be used in place of the product.

As used herein, it also is understood that the terms "substantially identical" or "similar" varies with the context as understood by those skilled in the relevant art.

As used herein, an allelic variant or allelic variation references any of two or more alternative forms of a gene occupying the same chromosomal locus. Allelic variation arises naturally through mutation, and can result in phenotypic polymorphism within populations. Gene mutations can be silent (no change in the encoded polypeptide) or can encode polypeptides having altered amino acid sequence. The term "allelic variant" also is used herein to denote a protein encoded by an allelic variant of a gene. Typically the reference form of the gene encodes a wildtype form and/or predominant form of a polypeptide from a population or single reference member of a species. Typically, allelic variants, which include variants between and among species typically have at least 80%, 90% or greater amino acid identity with a wildtype and/or predominant form from the same species; the degree of identity depends upon the gene and whether comparison is interspecies or intraspecies. Generally, intraspecies allelic variants have at least about 80%, 85%, 90% or 95% identity or greater with a wildtype and/or predominant form, including 96%, 97%, 98%, 99% or greater identity with a wildtype and/or predominant form of a polypeptide. Reference to an allelic variant herein generally refers to variations n proteins among members of the same species.

As used herein, "allele," which is used interchangeably herein with "allelic variant" refers to alternative forms of a gene or portions thereof. Alleles occupy the same locus or position on homologous chromosomes. When a subject has two identical alleles of a gene, the subject is said to be homozygous for that gene or allele. When a subject has two different alleles of a gene, the subject is said to be heterozygous for the gene. Alleles of a specific gene can differ from each other in a single nucleotide or several nucleotides, and can include modifications such as substitutions, deletions and insertions of nucleotides. An allele of a gene also can be a form of a gene containing a mutation.

As used herein, species variants refer to variants in polypeptides among different species, including different mammalian species, such as mouse and human. Exemplary of species variants provided herein are primate PH20, such as, but not limited to, human, chimpanzee, macaque and cynomologus monkey. Generally, species variants have 70%, 75%, 80%, 85%, 90%, 91%, 92%, 93%, 94%, 95%, 96%, 97%, 98% or sequence identity. Corresponding residues between and among species variants can be determined by comparing and aligning sequences to maximize the number of matching nucleotides or residues, for example, such that identity between the sequences is equal to or greater than 95%, equal to or greater than 96%, equal to or greater than 97%, equal to or greater than 98% or equal to or greater than 99%. The position of interest is then given the number assigned in the reference nucleic acid molecule. Alignment can be effected manually or by eye, particularly, where sequence identity is greater than 80%. For example, the alignment in FIG. 1 shows that amino acid residue 491 of human PH20 corresponds to amino acid residue 491 of chimpanzee PH20 and amino acid residue 497 of human PH20 corresponds to amino acid residue 498 of chimpanzee PH20.

As used herein, a splice variant refers to a variant produced by differential processing of a primary transcript of genomic DNA that results in more than one type of mRNA.

As used herein, modification is in reference to modification of a sequence of amino acids of a polypeptide or a sequence of nucleotides in a nucleic acid molecule and includes deletions, insertions, and replacements of amino acids and nucleotides, respectively. Methods of modifying a polypeptide are routine to those of skill in the art, such as by using recombinant DNA methodologies.

As used herein, the term promoter means a portion of a gene containing DNA sequences that provide for the binding of RNA polymerase and initiation of transcription. Promoter sequences are commonly, but not always, found in the 5' non-coding region of genes.

As used herein, isolated or purified polypeptide or protein or biologically-active portion thereof is substantially free of cellular material or other contaminating proteins from the cell or tissue from which the protein is derived, or substantially free from chemical precursors or other chemicals when chemically synthesized. Preparations can be determined to be substantially free if they appear free of readily detectable impurities as determined by standard methods of analysis, such as thin layer chromatography (TLC), gel electrophoresis and high performance liquid chromatography (HPLC), used by those of skill in the art to assess such purity, or sufficiently pure such that further purification would not detectably alter the physical and chemical properties, such as enzymatic and biological activities, of the substance. Methods for purification of the compounds to produce substantially chemically pure compounds are known to those of skill in the art. A substantially chemically pure compound, however, can be a mixture of stereoisomers. In such instances, further purification might increase the specific activity of the compound.

Hence, reference to a substantially purified polypeptide, such as a substantially purified extended soluble PH20 refers to preparations of PH20 proteins that are substantially free of cellular material includes preparations of proteins in which the protein is separated from cellular components of the cells from which it is isolated or recombinantly-produced. In one embodiment, the term substantially free of cellular material includes preparations of enzyme proteins having less that about 30% (by dry weight) of non-enzyme proteins (also referred to herein as a contaminating protein), generally less than about 20% of non-enzyme proteins or 10% of non-enzyme proteins or less that about 5% of non-enzyme proteins. When the enzyme protein is recombinantly produced, it also is substantially free of culture medium, i.e., culture medium represents less than about or at 20%, 10% or 5% of the volume of the enzyme protein preparation.

As used herein, the term substantially free of chemical precursors or other chemicals includes preparations of enzyme proteins in which the protein is separated from chemical precursors or other chemicals that are involved in the synthesis of the protein. The term includes preparations of enzyme proteins having less than about 30% (by dry weight), 20%, 10%, 5% or less of chemical precursors or non-enzyme chemicals or components.

As used herein, synthetic, with reference to, for example, a synthetic nucleic acid molecule or a synthetic gene or a synthetic peptide refers to a nucleic acid molecule or polypeptide molecule that is produced by recombinant methods and/or by chemical synthesis methods.

As used herein, production by recombinant means or using recombinant DNA methods means the use of the well known methods of molecular biology for expressing proteins encoded by cloned DNA.

As used herein, vector (or plasmid) refers to discrete elements that are used to introduce a heterologous nucleic acid into cells for either expression or replication thereof. The vectors typically remain episomal, but can be designed to effect integration of a gene or portion thereof into a chromosome of the genome. Also contemplated are vectors that are artificial chromosomes, such as yeast artificial chromosomes and mammalian artificial chromosomes. Selection and use of such vehicles are well known to those of skill in the art.

As used herein, an expression vector includes vectors capable of expressing DNA that is operatively linked with regulatory sequences, such as promoter regions, that are capable of effecting expression of such DNA fragments. Such additional segments can include promoter and terminator sequences, and optionally can include one or more origins of replication, one or more selectable markers, an enhancer, a polyadenylation signal, and the like. Expression vectors are generally derived from plasmid or viral DNA, or can contain elements of both. Thus, an expression vector refers to a recombinant DNA or RNA construct, such as a plasmid, a phage, recombinant virus or other vector that, upon introduction into an appropriate host cell, results in expression of the cloned DNA. Appropriate expression vectors are well known to those of skill in the art and include those that are replicable in eukaryotic cells and/or prokaryotic cells and those that remain episomal or those which integrate into the host cell genome.

As used herein, vector also includes "virus vectors" or "viral vectors." Viral vectors are engineered viruses that are operatively linked to exogenous genes to transfer (as vehicles or shuttles) the exogenous genes into cells.

As used herein, "operably" or "operatively linked" when referring to DNA segments means that the segments are arranged so that they function in concert for their intended purposes, e.g., transcription initiates downstream of the promoter and upstream of any transcribed sequences. The promoter is usually the domain to which the transcriptional machinery binds to initiate transcription and proceeds through the coding segment to the terminator.

As used herein the term "assessing" is intended to include quantitative and qualitative determination in the sense of obtaining an absolute value for the activity of a protease, or a domain thereof, present in the sample, and also of obtaining an index, ratio, percentage, visual or other value indicative of the level of the activity. Assessment can be direct or indirect and the chemical species actually detected need not of course be the proteolysis product itself but can for example be a derivative thereof or some further substance. For example, detection of a cleavage product of a complement protein, such as by SDS-PAGE and protein staining with Coomasie blue.

As used herein, biological activity refers to the in vivo activities of a compound or physiological responses that result upon in vivo administration of a compound, composition or other mixture. Biological activity, thus, encompasses therapeutic effects and pharmaceutical activity of such compounds, compositions and mixtures. Biological activities can be observed in in vitro systems designed to test or use such activities. Thus, for purposes herein a biological activity of a protease is its catalytic activity in which a polypeptide is hydrolyzed.

As used herein equivalent, when referring to two sequences of nucleic acids, means that the two sequences in question encode the same sequence of amino acids or equivalent proteins. When equivalent is used in referring to two proteins or peptides, it means that the two proteins or peptides have substantially the same amino acid sequence with only amino acid substitutions that do not substantially alter the activity or function of the protein or peptide. When equivalent refers to a property, the property does not need to be present to the same extent (e.g., two peptides can exhibit different rates of the same type of enzymatic activity), but the activities are usually substantially the same.

As used herein, "modulate" and "modulation" or "alter" refer to a change of an activity of a molecule, such as a protein. Exemplary activities include, but are not limited to, biological activities, such as signal transduction. Modulation can include an increase in the activity (i.e., up-regulation or agonist activity), a decrease in activity (i.e., down-regulation or inhibition) or any other alteration in an activity (such as a change in periodicity, frequency, duration, kinetics or other parameter). Modulation can be context dependent and typically modulation is compared to a designated state, for example, the wildtype protein, the protein in a constitutive state, or the protein as expressed in a designated cell type or condition.

As used herein, a composition refers to any mixture. It can be a solution, suspension, liquid, powder, paste, aqueous, non-aqueous or any combination thereof.

As used herein, a combination refers to any association between or among two or more items. The combination can be two or more separate items, such as two compositions or two collections, can be a mixture thereof, such as a single mixture of the two or more items, or any variation thereof. The elements of a combination are generally functionally associated or related.

As used herein, "disease or disorder" refers to a pathological condition in an organism resulting from cause or condition including, but not limited to, infections, acquired conditions, genetic conditions, and characterized by identifiable symptoms. Diseases and disorders of interest herein are those involving components of the ECM. As used herein, "treating" a subject with a disease or condition means that the subject's symptoms are partially or totally alleviated, or remain static following treatment. Hence treatment encompasses prophylaxis, therapy and/or cure. Prophylaxis refers to prevention of a potential disease and/or a prevention of worsening of symptoms or progression of a disease. Treatment also encompasses any pharmaceutical use of a modified interferon and compositions provided herein.

As used herein, a pharmaceutically effective agent, includes any therapeutic agent or bioactive agent, including, but not limited to, for example, anesthetics, vasoconstrictors, dispersing agents, conventional therapeutic drugs, including small molecule drugs, including, but not limited to, bisphosphonates, and therapeutic proteins, including, but not limited to, insulin, IgG molecules, and antibodies.

As used herein, a therapeutic agent, includes any pharmaceutically effective agent or bioactive agent, including, but not limited to, for example, anesthetics, vasoconstrictors, dispersing agents, conventional therapeutic drugs, including small molecule drugs, including, but not limited to, bisphosphonates, and therapeutic proteins, including, but not limited to, insulin, IgG molecules, and antibodies.

As used herein, treatment means any manner in which the symptoms of a condition, disorder or disease or other indication, are ameliorated or otherwise beneficially altered.

As used herein, therapeutic effect means an effect resulting from treatment of a subject that alters, typically improves or ameliorates the symptoms of a disease or condition or that cures a disease or condition. A therapeutically effective amount refers to the amount of a composition, molecule or compound which results in a therapeutic effect following administration to a subject.

As used herein, the term "subject" refers to an animal, including a mammal, such as a human being.

As used herein, a patient refers to a human subject exhibiting symptoms of a disease or disorder.

As used herein, amelioration of the symptoms of a particular disease or disorder by a treatment, such as by administration of a pharmaceutical composition or other therapeutic, refers to any lessening, whether permanent or temporary, lasting or transient, of the symptoms that can be attributed to or associated with administration of the composition or therapeutic.

As used herein, prevention or prophylaxis refers to methods in which the risk of developing disease or condition is reduced.

As used herein, a "therapeutically effective amount" or a "therapeutically effective dose" refers to the quantity of an agent, compound, material, or composition containing a compound that is at least sufficient to produce a therapeutic effect. Hence, it is the quantity necessary for preventing, curing, ameliorating, arresting or partially arresting a symptom of a disease or disorder.

As used herein, unit dose form refers to physically discrete units suitable for human and animal subjects and packaged individually as is known in the art.

As used herein, a single dosage formulation refers to a formulation for direct administration.

As used herein, an "article of manufacture" is a product that is made and sold. As used throughout this application, the term is intended to encompass a therapeutic agent with a soluble PH20, such as esPH20, or an esPH20 alone, contained in the same or separate articles of packaging.

As used herein, fluid refers to any composition that can flow. Fluids thus encompass compositions that are in the form of semi-solids, pastes, solutions, aqueous mixtures, gels, lotions, creams and other such compositions.

As used herein, a "kit" refers to a combination of compositions provided herein and another item for a purpose including, but not limited to, reconstitution, activation, and instruments/devices for delivery, administration, diagnosis, and assessment of a biological activity or property. Kits optionally include instructions for use.

As used herein, a cellular extract or lysate refers to a preparation or fraction which is made from a lysed or disrupted cell.

As used herein, animal includes any animal, such as, but are not limited to primates including humans, gorillas and monkeys; rodents, such as mice and rats; fowl, such as chickens; ruminants, such as goats, cows, deer, sheep; pigs and other animals. Non-human animals exclude humans as the contemplated animal. The enzymes provided herein are from any source, animal, plant, prokaryotic and fungal. Most enzymes are of animal origin, including mammalian origin.

As used herein, a control refers to a sample that is substantially identical to the test sample, except that it is not treated with a test parameter, or, if it is a plasma sample, it can be from a normal volunteer not affected with the condition of interest. A control also can be an internal control.

As used herein, the singular forms "a," "an" and "the" include plural referents unless the context clearly dictates otherwise. Thus, for example, reference to a compound comprising "an extracellular domain" includes compounds with one or a plurality of extracellular domains.

As used herein, ranges and amounts can be expressed as "about" a particular value or range. About also includes the exact amount. Hence "about 5 bases" means "about 5 bases" and also "5 bases."

As used herein, "optional" or "optionally" means that the subsequently described event or circumstance does or does not occur, and that the description includes instances where said event or circumstance occurs and instances where it does not. For example, an optionally substituted group means that the group is unsubstituted or is substituted.

As used herein, the abbreviations for any protective groups, amino acids and other compounds, are, unless indicated otherwise, in accord with their common usage, recognized abbreviations, or the IUPAC-IUB Commission on Biochemical Nomenclature (see, (1972) *Biochem.* 11:1726).

B. Overview

Hyaluronidases are enzymes that catalyze the hydrolysis of hyaluronic acid, thereby lowering the viscosity of hyaluronic acid and increasing tissue permeability. PH20 is a neutral-active and acid-active hyaluronidase that exhibits optimal activity when glycosylated. Human PH20 is a GPI-anchored protein that is anchored to the extracellular leaflet of the plasma membrane via a glycosylphosphatidylinositol (GPI) anchor attached to the C-terminus of the protein. The addition of the GPI anchor to all GPI-anchored proteins occurs following cleavage at a specific amino acid position, called the ω-site (typically located approximately 20-30 amino acids from the C-terminus), and removal of the C-terminal portion in the ER. This C-terminal portion is the GPI-anchor attachment signal sequence. The GPI-anchor attachment signal sequence of human PH20 is located at amino acid positions 491-509 of the precursor polypeptide set forth in SEQ ID NO:107, and the ω-site is amino acid position 490. GPI-anchored PH20 polypeptides such as human PH20 are membrane-bound and, therefore, insoluble. Insoluble forms of PH20 typically are not suitable for therapeutic purposes.

PH20 polypeptides that lack a GPI anchor generally are secreted by cells upon expression because they do not contain a GPI-attachment signal sequence that locks the polypeptide to the membrane. It is found herein that soluble forms of PH20 also include those that contain residues within the GPI-anchor attachment signal sequence. Extended soluble PH20 (esPH20) polypeptides are soluble PH20 proteins that are truncated at the C-terminus but retain one or more amino acid residues located in the GPI-anchor attachment signal sequence of the corresponding wild-type PH20 polypeptide. Such esPH20 polypeptides are soluble and can be used as therapeutic polypeptides, such as to treat hyaluronan-associated diseases or conditions and/or to serve as a spreading or dispersing agent to promote, enhance or increase the dispersion and delivery of other agents, drugs and proteins thereby improving the pharmacokinetic and pharmacodynamic profile of the co-administered agent, drug or protein.

1. PH20

PH20, also known as sperm surface protein, sperm adhesion molecule 1, SPAM1 or HYAL3, is a hyaluronidase. Hyaluronidases are a family of enzymes that degrade hyaluronic acid (also known as hyaluronan or hyaluronate or HA), an essential component of the extracellular matrix and a major constituent of the interstitial barrier. By catalyzing the hydrolysis of hyaluronic acid, hyaluronidase lowers the viscosity of hyaluronic acid, thereby increasing tissue permeability. As such, hyaluronidases have been used, for example, as a spreading or dispersing agent in conjunction with other agents, drugs and proteins to enhance their dispersion and delivery, and to improve the pharmacokinetic and pharmacodynamic profile of the co-administered agent, drug or protein.

PH20, like other mammalian hyaluronidases, is an endo-β-N-acetyl-hexosaminidase that hydrolyzes the β1→4 glycosidic bond of hyaluronic acid into various oligosaccharide lengths such as tetrasaccharides and hexasaccharides. PH20 has both hydrolytic and transglycosidase activities and can degrade hyaluronic acid and chondroitin sulfates, such as C4-S and C6-S. PH20 is naturally involved in sperm-egg adhesion and aids penetration by sperm of the layer of cumulus cells by digesting hyaluronic acid. PH20 is located on the sperm surface, and in the lysosome-derived acrosome, where it is bound to the inner acrosomal membrane. Plasma membrane PH20 has hyaluronidase activity only at neutral pH, while inner acrosomal membrane PH20 has activity at both neutral and acidic pH. In addition to being a hyaluronidase, PH20 also appears to be a receptor for HA-induced cell signaling, and a receptor for the zona pellucida surrounding the oocyte.

Exemplary PH20 proteins include, but are not limited to, human (precursor polypeptide set forth in SEQ ID NO:107, mature polypeptide set forth in SEQ ID NO:108), bovine (SEQ ID NOS:111 and 119), rabbit (SEQ ID NO:112), ovine (SEQ ID NOS:113, 118 and 120), Cynomolgus monkey (SEQ ID NO:114), guinea pig (SEQ ID NO:115), rat (SEQ ID NO:116), mouse (SEQ ID NO:117), chimpanzee (SEQ ID NO:197) and Rhesus monkey (SEQ ID NO:198) PH20 polypeptides. The human PH20 mRNA transcript is normally translated to generate a 509 amino acid precursor protein (SEQ ID NO:107) containing a 35 amino acid signal sequence at the N-terminus (amino acid residue positions 1-35 of SEQ ID NO:107). Thus, following transport to the ER and removal of the signal peptide, a 474 amino acid mature polypeptide with an amino acid sequence set forth in SEQ ID NO:108 is produced. As discussed below, a C-terminal peptide is then cleaved in the ER to facilitate covalent attachment of a GPI anchor to the newly-formed C-terminal amino acid at the amino acid position corresponding to position 490 of the precursor polypeptide set forth in SEQ ID NO:107.

Human PH20 is the prototypical neutral-active hyaluronidase that is generally locked to the plasma membrane via a glycosylphosphatidylinositol (GPI) anchor. As noted above, PH20 also is expressed on the inner acrosomal membrane where it has hyaluronidase activity at both neutral and acidic pH. Evidence suggests that the Peptide 1 region of PH20, which corresponds to amino acids 142-172 of the precursor polypeptide set forth in SEQ ID NO:107, is required for enzyme activity at neutral pH. The Peptide 3 region, which corresponds to amino acids 277-297 of the precursor polypeptide set forth in SEQ ID NO:107, appears to be important for enzyme activity at acidic pH (Cherr et al., (2001) *Matrix Biology* 20:515-525). Thus, it appears that PH20 contains two catalytic sites. In addition to the catalytic sites, PH20 also contains a hyaluronan-binding site. Experimental evidence suggests that this site is located in the Peptide 2 region, which corresponds to amino acid positions 205-235 of the precursor polypeptide set forth in SEQ ID NO:107. This region is highly conserved among hyaluronidases and is similar to the heparin binding motif.

a. Glycosylation

Glycosylation, including N- and O-linked glycosylation, of some hyaluronan degrading enzymes, including hyaluronidases, can be important for their catalytic activity and stability. N-linked oligosaccharides fall into several major types (oligomannose, complex, hybrid), all of which have $(Man)_3$-GlcNAc-GlcNAc-cores attached via the amide nitrogen of Asn residues that fall within -Asn-Xaa-Thr/Ser-sequences (where Xaa is not Pro). An additional glycosylation site at -Asn-Xaa-Cys- has been reported for coagulation protein C. In some instances, a hyaluronan degrading enzyme, such as a hyaluronidase, can contain both N-glycosidic and O-glycosidic linkages. For example, PH20 has one O-linked oligosaccharide at amino acid T475 as well as six N-linked oligosaccharides at amino acids N82, N166, N235, N254, N368, and N393 of human PH20, exemplified in SEQ ID NO: 107. Amino acid residues N82, N166 and N254 are occupied by complex type glycans whereas amino acid residues N368 and N393 are occupied by high mannose type glycans (see, e.g. Example 6 below). Amino acid residue N235 is occupied by approximately 80% high mannose type glycans and 20% complex type glycans.

While altering the type of glycan modifying a glycoprotein can have dramatic affects on a protein's antigenicity, structural folding, solubility, and stability, most enzymes are not thought to require glycosylation for optimal enzyme activity. For some hyaluronidases, removal of N-linked glycosylation can result in near complete inactivation of the hyaluronidase activity. Thus, for such hyaluronidases, the presence of N-linked glycans is required for generating an active enzyme. The presence of N-linked glycans in PH20 polypeptides is required for generating an active enzyme. For example, it is found herein, that complete deglycosylation of human PH20, by treatment with the endoglycosidase PNGaseF or the GlcNAc phosphotransferase (GPT) inhibitor tunicamycin, results in the total loss of hyaluronidase activity (see, e.g. Examples 7-8, below). In contrast, partial deglycosylation of human PH20, by treatment with endoglycosidase EndoF1, EndoF2, EndoF3 or EndoH, does not affect the hyaluronidase activity of human PH20 (see, e.g., Example 7, below).

b. GPI-Anchoring

Human PH20 is a GPI-anchored protein. As such, the PH20 polypeptide is anchored to the extracellular leaflet of the plasma membrane via a glycosylphosphatidylinositol (GPI) anchor attached to the C-terminus of the protein. GPI-anchored proteins such as human PH20 are translated with a cleavable N-terminal signal peptide that directs the protein to the endoplasmic reticulum (ER). At the C-terminus of these proteins is another signal sequence that directs addition of a preformed GPI-anchor to the polypeptide within the lumen of the ER. Addition of the GPI anchor occurs following cleavage of the C-terminal portion at a specific amino acid position, called the ω-site (typically located approximately 20-30 amino acids from the C-terminus). Although there appears to be no consensus sequence to identify the location of the ω-site, GPI anchored proteins contain a C-terminal GPI-anchor attachment signal sequence or domain that typically contains a predominantly hydrophobic region of 8-20 amino acids, preceded by a hydrophilic spacer region of 8-12 amino acids immediately downstream of the ω-site. This hydrophilic spacer region often is rich in charged amino acids and proline (White et al., (2000) *J Cell Sci.* 113 (Pt. 4):721-727). More detailed analysis suggests that there is a region of approximately 11 amino acids before the ω-1 position that is characterized by a low amount of predicted secondary structure, a region around the cleavage site (ω-site), from ω-1 to ω+2 that is characterized by the presence of small side chain residues, the spacer region between positions ω+3 and ω+9, and a hydrophobic tail from ω+10 to the C-terminal end (Pierleoni et al., (2008) *BMC Bioinformatics* 9:392).

Although there is no GPI-anchor attachment signal consensus sequence, various in silico methods and algorithms have been developed that can be used to identify such sequences in polypeptides (see, e.g. Udenfriend et al. (1995) *Methods Enzymol.* 250:571-582; Eisenhaber et al., (1999) *J.*

Biol. Chem. 292: 741-758; Kronegg and Buloz, (1999), "Detection/prediction of GPI cleavage site (GPI-anchor) in a protein (DGPI)," 129.194.185.165/dgpi/; Fankhauser et al., (2005) Bioinformatics 21:1846-1852; Omaetxebarria et al., (2007) Proteomics 7:1951-1960; Pierleoni et al., (2008) BMC Bioinformatics 9:392), including those that are readily available on bioinformatic websites, such as the ExPASy Proteomics tools site (expasy.ch/tools/). Thus, one of skill in the art can determine whether a PH20 polypeptide likely contains a GPI-anchor attachment signal sequence, and, therefore, whether the PH20 polypeptide is a GPI-anchored protein.

The GPI-anchor attachment signal sequence of human PH20 is located at amino acid positions 491-509 of the precursor polypeptide set forth in SEQ ID NO:107, and the ω-site is amino acid position 490. Thus, in this modeling of human PH20, amino acids 491-509 are cleaved following transport to the ER and a GPI anchor is covalently attached to the serine residue at position 490. The covalent attachment of a GPI-anchor to the C-terminus of human PH20 and, therefore, the membrane-bound nature of PH20, has been confirmed using phosphatidylinositol-specific phospholipase C (PI-PLC) hydrolysis studies (see, e.g., Lin et al., (1994) J. Biol. Chem. 125:1157-1163 and Example 3, below). Phosphatidylinositol-specific phospholipase C (PI-PLC) and D (PI-PLD) hydrolyze the GPI anchor, releasing the PH20 polypeptide from the cell membrane. The resulting released PH20 polypeptide is, therefore, soluble. Soluble PH20 can be detected and discriminated from insoluble, membrane-bound PH20 using methods well known in the art, including, but not limited to, those using a Triton® X-114 assay, as described below and in Example 4. In this assay, soluble PH20 hyaluronidases partition into the aqueous phase of a Triton® X-114 solution warmed to 37° C. (Bordier et al., (1981) J. Biol. Chem., 256:1604-7) while membrane-anchored PH20 hyaluronidases partition into the detergent rich phase. Thus, in addition to using algorithms to assess whether a PH20 polypeptide is naturally GPI-anchored, solubility experiments also can be performed.

C. Extended Soluble PH20 Polypeptides

Provided herein are extended soluble PH20 (esPH20) polypeptides and compositions. Exemplary of the esPH20 polypeptides provided herein are primate esPH20 polypeptides, including, but not limited to, human and chimpanzee esPH20 polypeptides. The esPH20 polypeptides provided herein are soluble, i.e. secreted, PH20 proteins that are truncated at the C-terminus but retain at least one or more amino acid residues located in the GPI-anchor attachment signal sequence of the corresponding wild-type PH20 polypeptide (e.g. are truncated at amino acid positions 491-500). EsPH20 polypeptides can be produced from any GPI-anchored PH20 polypeptide by modification of the GPI-anchored PH20 polypeptide, that is by removal of a portion of the GPI-anchor attachment signal sequence, provided that the resulting esPH20 polypeptide is soluble. Solubility, or secretion into the cell culture medium, can be determined by SDS-PAGE and western blot analysis upon expression, or alternatively, in a Triton® X-114 assay, as described below and in Example 4, when the PH20 polypeptide is produced by any method known to one of skill in the art, including recombinant expression and polypeptide synthesis. The esPH20 polypeptides provided herein can be used, for example, as therapeutic polypeptides, such as a spreading or dispersing agent in conjunction with other agents, drugs and proteins to enhance their dispersion and delivery, and to improve the pharmacokinetic and pharmacodynamic profile of the co-administered agent, drug or protein.

The esPH20 polypeptides provided herein contain 1, 2, 3, 4, 5, 6, 7 or more amino acid residues from the GPI-anchor attachment signal sequence, providing the esPH20 polypeptide is soluble, i.e., partitions into the aqueous phase of a Triton® X-114 solution, as described below. The extended soluble PH20 polypeptides provided herein can be produced by making C-terminal truncations to any naturally GPI-anchored PH20 polypeptide, wherein the resulting esPH20 polypeptide is soluble and contains 1 or more amino acid residues from the GPI-anchor attachment signal sequence. One of skill in the art can determine whether a PH20 polypeptide is GPI-anchored using methods well known in the art. Such methods include, but are not limited to, using known algorithms to predict the presence and location of the GPI-anchor attachment signal sequence and ω-site, and performing solubility analyses before and after digestion with phosphatidylinositol-specific phospholipase C (PI-PLC) or D (PI-PLD).

Exemplary esPH20 polypeptides include, but are not limited to, esPH20 polypeptides of primates, such as, for example, human and chimpanzee esPH20 polypeptides. For example, the esPH20 polypeptides provided herein can be made by C-terminal truncation of any of the mature or precursor polypeptides set forth in SEQ ID NOS:107, 108, or 197, or allelic or other variations thereof, including active fragments thereof, wherein the resulting polypeptide is soluble and retains 1 or more amino acid residues from the GPI-anchor attachment signal sequence. Allelic variants and other variants are known to one of skill in the art, and include polypeptides having 60%, 70%, 80%, 90%, 91%, 92%, 93%, 94%, 95% or more sequence identity to any of SEQ ID NOS: 107, 108 and 197. The esPH20 polypeptides provided herein can be C-terminally truncated by 1, 2, 3, 4, 5, 6, 7, 8, 9, 10 or more amino acids compared to the wild type polypeptide, such as a polypeptide with a sequence set forth in SEQ ID NOS: 107, 108 and 197, provided the resulting esPH20 polypeptide is soluble and retains 1 or more amino acid residues from the GPI-anchor attachment signal sequence.

The extended soluble PH20 polypeptides provided herein retain hyaluronidase activity. Additionally, the esPH20 polypeptides are neutral active, that is, they retain hyaluronidase activity at neutral pH. The hyaluronidase activity can be increased or decreased compared to the wild-type GPI-anchored form of the PH20. For example, the esPH20 polypeptides provided herein can exhibit hyaluronidase activity that is 1%, 10%, 20%, 30%, 40%, 50%, 60%, 70%, 80%, 90%, 100%, 110%, 120%, 130%, 140%, 150%, 200%, 300%, 400%, 500%, 1000% or more of the hyaluronidase activity exhibited by the wildtype GPI-anchored form.

1. Human esPH20 Polypeptides

Exemplary of the esPH20 polypeptides provided herein are human esPH20 polypeptides. The human esPH20 polypeptides provided herein are soluble and contain 1 or more amino acid residues from the GPI-anchor attachment signal sequence. Thus, provided herein are soluble forms of human PH20 that GPI do not completely lack the GPI-anchor attachment signal sequence.

Precursor human esPH20 polypeptides provided herein include, but are not limited to, those having C-terminal truncations to generate polypeptides containing amino acid 1 to amino acid 491, 492, 493, 494, 495, 496, 497, 498, 499 or 500 of the sequence of amino acids set forth in SEQ ID NO: 107. When expressed in mammalian cells, the 35 amino acid N-terminal signal sequence is cleaved during processing, and the mature form of the protein is secreted. Thus, the mature human esPH20 polypeptides contain amino acids 36 to 491, 492, 493, 494, 495, 496, 497, 498, 499 or 500 of SEQ ID NO:107. Hence, mature human esPH20 polypeptides provided herein include those set forth in SEQ ID NOS: 59-63 and 100-104, or allelic or other variants thereof.

The human esPH20 polypeptides provided herein can be expressed in CHO cells, or alternatively produced in any cell or by any method known to one of skill in the art, provided they are soluble and contain at least one amino acid from the GPI-anchor attachment signal sequence. Soluble human esPH20 polypeptides produced in CHO cells are those that are secreted into the cell culture medium. It is understood by one of skill in the art that a human esPH20 can be partially secreted, that is, 50%, 55%, 60%, 65%, 70%, 75%, 80%, 85%, 90%, 91%, 92%, 93%, 94%, 95%, 96%, 97%, 98%, 99% or more of the expressed polypeptide is secreted into the culture medium, provided that the secreted esPH20 is soluble, i.e., partitions into the aqueous phase of a Triton® X-114 solution, as described below. Human esPH20 polypeptides provided herein that contain amino acids 1-500, or 36-500, are partially secreted. Additionally, when expressed in CHO cells, the precursor human esPH20 polypeptides containing amino acids 1 to 498, 499 or 500, or the mature human esPH20 polypeptides containing amino acids 36 to 498, 499 or 500, are weakly expressed (see, e.g., Example 3 below).

Thus, exemplary precursor human esPH20 polypeptides include, but are not limited to, any having C-terminal truncations to generate polypeptides containing amino acid 1 to amino acid 491, 492, 493, 494, 495, 496 or 497 of the sequence of amino acids set forth in SEQ ID NO: 107. When expressed in mammalian cells, following cleavage of the N-terminal signal peptide during processing, mature human esPH20 polypeptides contain amino acids 36 to 491, 492, 493, 494, 495, 496 or 497 of SEQ ID NO:107. Hence, exemplary mature human esPH20 polypeptides provided herein include those that are 456, 457, 458, 459, 460, 461 or 462 amino acids in length, such as set forth in any of SEQ ID NOS: 60-63 and 102-104, or allelic or other variants thereof. Allelic variants and other variants are known to one of skill in the art, and include polypeptides having 60%, 70%, 80%, 90%, 91%, 92%, 93%, 94%, 95% or more sequence identity to any of SEQ ID NOS: 107 or 108.

Also provided herein are amino acid-substituted human esPH20 polypeptides, Amino acid substituted esPH20 polypeptides are human esPH20 polypeptides that are modified such that they contain amino acid substitutions, as compared to the human esPH20 polypeptides provided herein, for example, as set forth in SEQ ID NOS: 60-63 and 102-104. Thus, amino acid-substituted human esPH20 polypeptides are those having C-terminal truncations. In some examples, the amino acid substituted human esPH20 polypeptides provided herein have at least 50%, 55%, 60%, 65%, 70%, 75%, 80%, 85%, 87%, 90%, 91%, 92%, 93%, 94%, 95%, 96%, 97%, 98%, 99% or more sequence identity with the sequence of amino acids set forth as amino acids 1 to 491, 492, 493, 494, 495, 496 or 497, or amino acids 36 to 491, 492, 493, 494, 495, 496 or 497, of the sequence of amino acids set forth in SEQ ID NO: 107. In other examples, the amino acid substituted human esPH20 polypeptides have 85%, 87%, 90%, 91%, 92%, 93%, 94%, 95%, 96%, 97%, 98%, 99% or more sequence identity with the sequence of amino acids set forth as in SEQ ID NOS: 60-63 and 102-104.

The human esPH20 polypeptides provided herein can exhibit hyaluronidase activity that is increased or decreased compared to the wild-type GPI-anchored form of PH20. For example, the human esPH20 polypeptides provided herein can exhibit hyaluronidase activity that is 1%, 10%, 20%, 30%, 40%, 50%, 60%, 70%, 80%, 90%, 100%, 110%, 120%, 130%, 140%, 150%, 200%, 300%, 400%, 500%, 1000% or more of the hyaluronidase activity exhibited by the wildtype GPI-anchored form. In some examples, human esPH20 polypeptides exhibit increased hyaluronidase activity compared to the wildtype GPI-anchored form. The hyaluronidase activity of human esPH20 polypeptides can be increased by 1%, 2%, 3%, 4%, 5%, 10%, 20%, 30%, 40%, 50%, 60%, 70%, 80%, 90%, 100%, 110%, 120%, 130%, 140%, 150%, 200%, 300%, 400%, 500%, 1000% or more compared to the hyaluronidase activity of the wildtype GPI-anchored form.

The human esPH20 polypeptides provided herein exhibit neutral active hyaluronidase activity, or hyaluronidase activity when measured at neutral pH, that is increased or decreased compared to the compared to the wild-type GPI-anchored form of PH20. For example, the human esPH20 polypeptides provided herein can exhibit hyaluronidase activity that is 1%, 10%, 20%, 30%, 40%, 50%, 60%, 70%, 80%, 90%, 100%, 110%, 120%, 130%, 140%, 150%, 200%, 300%, 400%, 500%, 1000% or more of the hyaluronidase activity exhibited by the wildtype GPI-anchored form. In some examples, human esPH20 polypeptides exhibit decreased neutral active hyaluronidase activity compared to the wildtype GPI-anchored form. The neutral active hyaluronidase activity can be decreased by 1%, 2%, 3%, 4%, 5%, 10%, 20%, 30%, 40%, 50%, 60%, 70%, 80%, 90%, 95% or more compared to the neutral active hyaluronidase activity of the wildtype GPI-anchored form. In other examples, human esPH20 polypeptides exhibit increased neutral active hyaluronidase activity compared to the wildtype GPI-anchored form. The neutral active hyaluronidase activity can be increased by 1%, 2%, 3%, 4%, 5%, 10%, 20%, 30%, 40%, 50%, 60%, 70%, 80%, 90%, 100%, 110%, 120%, 130%, 140%, 150%, 200%, 300%, 400%, 500%, 1000% or more compared to the neutral active hyaluronidase activity of the wildtype GPI-anchored form.

Typically, human esPH20 polypeptides are produced using protein expression systems that facilitate correct N-glycosylation to ensure the polypeptide retains activity, since glycosylation is important for the catalytic activity and stability of these polypeptides. Exemplary cells useful for recombinant expression of esPH20 polypeptides include, for example Chinese Hamster Ovary (CHO) cells (e.g. DG44 CHO or CHO—S cells).

2. Other Species esPH20 Polypeptides

Provided herein are non-human extended soluble PH20 polypeptides. One of skill in art can align the amino acid sequence of human PH20 with any non-human PH20 polypeptide to identify positions corresponding to positions 491-500 of the human PH20 polypeptide set forth in SEQ ID NO:107, and at which C-terminal truncations can be made to produce extended soluble PH20 polypeptides. Additionally, algorithms, such as those described elsewhere herein, can be used to predict the location of the GPI-anchor attachment signal sequence. The solubility of the C-terminally truncated polypeptides can be assessed using methods well known in the art, including the Triton® X-114 assays described below and in Example 4, to determine whether the produced C-terminally truncated polypeptides are soluble and, therefore, esPH20 polypeptides.

Provided herein are extended soluble PH20 polypeptides of non-human primate species. Exemplary non-human primate GPI-anchored PH20 polypeptides include, but are not limited to, chimpanzee PH20 (SEQ ID NO:197). Thus, provided herein are chimpanzee esPH20 polypeptides. The esPH20 polypeptides of chimpanzee provided herein contain C-terminal truncations that correspond to the C-terminal truncations described above for the human esPH20 polypeptides. Thus, the chimpanzee esPH20 polypeptides provided herein contain amino acids corresponding to amino acid residues 1 to 491, 492, 493, 494, 495, 496, 497, 498, 499, 500 or 501 of the sequence of amino acids set forth in SEQ ID NO: 107.

The chimpanzee PH20 polypeptides can be aligned to the human PH20 polypeptide by any method known to those of skill in the art. Such methods typically maximize matches, and include methods such as using manual alignments and by using the numerous alignment programs available (for example, BLASTP) and others known to those of skill in the art. FIG. 1 provides an alignment of the precursor polypeptides of human and chimpanzee PH20. Amino acid residues 491 to 500 of the human PH20 (at which the human esPH20 polypeptides provided herein are truncated compared to the wild-type human PH20 polypeptide) correspond to amino acid residues 491 to 501 of chimpanzee PH20. Thus, provided herein are chimpanzee esPH20 polypeptides that contain amino acid residues 1 to 491, 492, 493, 494, 495, 496, 497, 498, 499, 500 or 501 of the sequence of amino acids set forth in SEQ ID NO: 197. When expressed in a mammalian expression system, the 35 amino acid signal peptide is cleaved during processing, and the mature form of the protein is secreted. Thus, the mature chimpanzee esPH20 polypeptides contain amino acids 36 to 491, 492, 493, 494, 495, 496, 497, 498, 499, 500 or 501 of SEQ ID NO:197.

Exemplary chimpanzee esPH20 polypeptide are those that contain amino acids residues 1 to 491, 492, 493, 494, 495, 496, 497 or 498 of the sequence of amino acids set forth in SEQ ID NO:197. When expressed in a mammalian expression system, the 35 amino acid signal peptide is cleaved during processing, and the mature form of the protein is secreted. Thus, the mature chimpanzee esPH20 polypeptides contain amino acids 36 to 491, 492, 493, 494, 495, 496, 497, or 498 of SEQ ID NO:197.

D. N-Partially Glycosylated PH20 Polypeptides

Provided herein are N-partially glycosylated hyaluronidases, including partially deglycosylated PH20 polypeptides, that retain all or a portion of the hyaluronidase activity of an N-glycosylated hyaluronidase. Exemplary partially deglycosylated hyaluronidases include partially deglycosylated PH20 polypeptides from any species, such as any set forth in any of SEQ ID NOS:107-109, 111-120, 197 and 198, or allelic variants or other variants thereof. Allelic variants and other variants are known to one of skill in the art, and include polypeptides having 60%, 70%, 80%, 90%, 91%, 92%, 93%, 94%, 95% or more sequence identity to any of SEQ ID NOS: NOS:107-109, 111-120, 197 and 198, or truncated forms thereof. The partially deglycosylated hyaluronidases provided herein also include hybrid, fusion and chimeric partially deglycosylated hyaluronidases, and partially deglycosylated hyaluronidase conjugates.

The N-partially glycosylated hyaluronidases provided herein can be produced by digestion with one or more glycosidases. Thus, although all N-linked glycosylation sites (such as, for example, those at amino acids N82, N166, N235, N254, N368, and N393 of human PH20, exemplified in SEQ ID NO:107) can be glycosylated, the extent of glycosylation is reduced compared to a hyaluronidase that is not digested with one or more glycosidases. The partially deglycosylated hyaluronidase polypeptides provided herein, including partially deglycosylated soluble PH20 polypeptides, can have 10%, 20%, 30%, 40%, 50%, 60%, 70% or 80% of the level of glycosylation of a fully glycosylated hyaluronidase. In one example, 1, 2, 3, 4, 5 or 6 of the N-glycosylation sites corresponding to amino acids N82, N166, N235, N254, N368, and N393 of SEQ ID NO: 107 are partially deglycosylated, such that they no longer contain high mannose or complex type glycans, but rather contain at least an N-acetylglucosamine moiety. In some examples, 1, 2 or 3 of the N-glycosylation sites corresponding to amino acids N82, N166 and N254 of SEQ ID NO: 107 are deglycosylated, that is, they do not contain a sugar moiety. In other examples, 3, 4, 5, or 6 of the N-glycosylation sites corresponding to amino acids N82, N166, N235, N254, N368, and N393 of SEQ ID NO: 107 are glycosylated. Glycosylated amino acid residues minimally contain an N-acetylglucosamine moiety.

Also provided herein are N-partially glycosylated C-terminally truncated PH20 polypeptides. The partially deglycosylated C-terminally truncated PH20 polypeptides provided herein lack one or more amino acids from the C-terminus of a full length PH20 polypeptide, such as any of those set forth in SEQ ID NOS:107-109, 111-120, 197 and 198. Thus, the N-partially glycosylated C-terminally truncated PH20 polypeptides provided herein can be C-terminally truncated by 1, 2, 3, 4, 5, 6, 7, 8, 9, 10, 11, 12, 13, 14, 15, 16, 17, 18, 19, 20, 25, 30, 35, 40, 45, 50, 55, 60 or more amino acids compared to the full length wild type polypeptide, such as a full length wild type polypeptide with a sequence set forth in SEQ ID NOS:107-109, 111-120, 197 and 198. In some examples, 3, 4, 5, or 6 of the N-glycosylation sites corresponding to amino acids N82, N166, N235, N254, N368, and N393 of SEQ ID NO: 107 are glycosylated. Glycosylated amino acid residues minimally contain an N-acetylglucosamine moiety. In other examples, 1, 2 or 3 of the N-glycosylation sites corresponding to amino acids N82, N166, N235, N254, N368, and N393 of SEQ ID NO: 107 are not glycosylated. In further examples, the extent of glycosylation can be reduced, such that, the partially glycosylated C-terminally truncated PH20 polypeptides do not contain high mannose and complex type glycans, rather they contain at least an N-acetylglucosamine moiety, so long as they retain hyaluronidase activity. Thus the partially deglycosylated C-terminally truncated PH20 polypeptides provided herein can have 10%, 20%, 30%, 40%, 50%, 60%, 70% or 80% of the level of glycosylation of a fully glycosylated C-terminally truncated PH20 polypeptide.

The partially deglycosylated PH20 polypeptides and C-terminally truncated PH20 polypeptides provided herein retain hyaluronidase activity. Additionally, the partially deglycosylated PH20 polypeptides and C-terminally truncated PH20 polypeptides are neutral active, that is, they retain hyaluronidase activity at neutral pH. The hyaluronidase activity can be increased or decreased compared to the glycosylated full length and C-terminally truncated PH20 polypeptides. For example, the partially deglycosylated PH20 polypeptides and C-terminally truncated PH20 polypeptides provided herein can exhibit hyaluronidase activity that is 1%, 10%, 20%, 30%, 40%, 50%, 60%, 70%, 80%, 90%, 100%, 110%, 120%, 130%, 140%, 150%, 200%, 300%, 400%, 500%, 1000% or more of the hyaluronidase activity exhibited by the glycosylated full length and C-terminally truncated PH20 polypeptides.

Thus, the PH20 polypeptides provided herein can be used as therapeutic polypeptides, such as to treat hyaluronan-associated diseases or conditions. The partially deglycosylated PH20 polypeptides and C-terminally truncated PH20 polypeptides also can be used, for example, in combination therapy.

1. PH20 Polypeptides

Exemplary N-partially glycosylated hyaluronidases provided herein include partially deglycosylated PH20 polypeptides from any species, such as any set forth in any of SEQ ID NOS:107-109, 111-120, 197 and 198, or allelic variants or other variants thereof. Allelic variants and other variants are known to one of skill in the art, and include polypeptides having 60%, 70%, 80%, 90%, 91%, 92%, 93%, 94%, 95% or more sequence identity to any of SEQ ID NOS: NOS:107-109, 111-120, 197 and 198, or truncated forms thereof. In some examples, 3, 4, 5, or 6 of the N-glycosylation sites corresponding to amino acids N82, N166, N235, N254, N368, and N393 of SEQ ID NO: 107 are glycosylated. In other examples, 1, 2, or 3 of the N-glycosylation sites corresponding to amino acids N82, N166 and N254 of SEQ ID NO: 107 are not glycosylated. In some examples, 1, 2, 3, 4, 5, or 6 of the N-glycosylation sites corresponding to amino acids N82, N166, N235, N254, N368, and N393 of SEQ ID NO: 107 minimally contain an N-acetylglucosamine moiety.

The partially deglycosylated hyaluronidases provided herein can be produced by digestion with one or more glycosidases. Thus, although all N-linked glycosylation sites (such as, for example, those at amino acids N82, N166, N235, N254, N368, and N393 of human PH20, exemplified in SEQ ID NO:107) can be glycosylated, the extent of glycosylation is reduced compared to a hyaluronidase that is not digested with one or more glycosidases. In particular, partially glycosylated hylaruonidases retain at least an N-acetylglucosamine moiety at each of the N-linked glycosylation sites. Partially glycosylated hyaluronidases can be glycosylated at 3, 4, 5, or 6 of the N-glycosylation sites corresponding to amino acids N82, N166, N235, N254, N368, and N393 of SEQ ID NO: 107. In some examples, the hyaluronidases are deglycosylated at 1, 2, or 3 of the N-glycosylation sites corresponding to amino acid residues N82, N166, N235, N254, N368, and N393 of SEQ ID NO: 107. The partially deglycosylated PH20 polypeptides provided herein can have 10%, 20%, 30%, 40%, 50%, 60%, 70% or 80% of the level of glycosylation of a fully glycosylated hyaluronidase.

Glycosidases, or glycoside hydrolases, are enzymes that catalyze the hydrolysis of the glycosidic linkage to generate two smaller sugars. As shown in FIG. 2, the major types of N-glycans in vertebrates include high mannose glycans, hybrid glycans and complex glycans. There are several glycosidases that result in only partial protein deglycosylation, including: EndoF1, which cleaves high mannose and hybrid type glycans; EndoF2, which cleaves biantennary complex type glycans; EndoF3, which cleaves biantennary and more branched complex glycans; and EndoH, which cleaves high mannose and hybrid type glycans (FIG. 3). Treatment of a hyaluronidase, such as a soluble hyaluronidase, such as a soluble PH20, with one or all of these glycosidases results can result in only partial deglycosylation and, therefore, retention of hyaluronidase activity.

For example, treatment of rHuPH20 with one or all of these glycosidases results in partial deglycosylation. These partially deglycosylated rHuPH20 polypeptides exhibit hyaluronidase enzymatic activity that is comparable to the fully glycosylated polypeptides (see e.g. Example 7). In contrast, treatment of rHuPH20 (SEQ ID NO:122) with PNGaseF, a glycosidase that cleaves all N-glycans (see FIG. 3), or treatment with the GlcNAc phosphotransferase (GPT) inhibitor tunicamycin, results in complete deglcosylation of all N-glycans and thereby renders PH20 enzymatically inactive (see e.g., Examples 7-8, below).

The partially deglycosylated hyaluronidase polypeptides provided herein, including partially deglycosylated soluble PH20 polypeptides, can have 10%, 20%, 30%, 40%, 50%, 60%, 70% or 80% of the level of glycosylation of a fully glycosylated hyaluronidase. Typically, the partially deglycosylated hyaluronidases, including partially deglycosylated soluble PH20 polypeptides, provided herein exhibit hyaluronidase activity that is 10%, 20%, 30%, 40%, 50%, 60%, 70%, 80%, 90%, 100%, 110%, 120%, 130%, 140%, 150%, 200%, 300%, 400%, 500%, 1000% or more of the hyaluronidase activity exhibited by the fully glycosylated hyaluronidase.

The partially deglycosylated hyaluronidases provided herein also include hybrid, fusion and chimeric partially deglycosylated hyaluronidases, and partially deglycosylated hyaluronidase conjugates.

2. C-Terminally Truncated PH20 Polypeptides

Exemplary of the N-partially glycosylated, or partially deglycosylated, PH20 peptides provided herein are C-terminally truncated PH20 polypeptides. The partially glycosylated C-terminally truncated PH20 polypeptides provided herein lack one or more amino acids from the C-terminus of the full length PH20 polypeptide as set forth in SEQ ID NOS:107-109, 111-120, 197 and 198. Thus, the partially glycosylated C-terminally truncated PH20 polypeptides provided herein can be C-terminally truncated by 1, 2, 3, 4, 5, 6, 7, 8, 9, 10, 11, 12, 13, 14, 15, 16, 17, 18, 19, 20, 25, 30, 35, 40, 45, 50, 55, 60 or more amino acids compared to the full length wild type polypeptide, such as a full length wild type polypeptide with a sequence set forth in SEQ ID NOS:107-109, 111-120, 197 and 198. In some examples, 3, 4, 5, or 6 of the N-glycosylation sites, corresponding to amino acids N82, N166, N235, N254, N368, and N393 of SEQ ID NO: 107, are glycosylated. In other examples, 1, 2, or 3 of the N-glycosylation sites, corresponding to amino acids N82, N166 and N254 of SEQ ID NO: 107, are not glycosylated.

The partially deglycosylated C-terminally truncated PH20 polypeptides provided herein can be produced by digestion with one or more glycosidases. Although all N-linked glycosylation sites (such as, for example, those at amino acids N82, N166, N235, N254, N368, and N393 of human PH20, exemplified in SEQ ID NO:107) can be glycosylated, the extent of glycosylation is reduced compared to a hyaluronidase that is not digested with one or more glycosidases. Thus, the partially deglycosylated C-terminally truncated PH20 polypeptides provided herein can have 10%, 20%, 30%, 40%, 50%, 60%, 70% or 80% of the level of glycosylation of a fully glycosylated hyaluronidase. In particular, N-partially glycosylated hylaruonidases retain at least an N-acetylglucosamine moiety at each of the N-linked glycosylation sites. In some examples, 1, 2, 3, 4, 5, or 6 of the N-glycosylation sites corresponding to amino acids N82, N166, N235, N254, N368, and N393 of SEQ ID NO: 107 minimally contain an N-acetylglucosamine moiety. In other examples, 3, 4, 5, or 6 of the N-glycosylation sites corresponding to amino acids N82, N166, N235, N254, N368, and N393 of SEQ ID NO: 107 are glycosylated at the level of glycosylation of a fully glycosylated hyaluronidase at each of the 3, 4, 5, or 6 N-glycosylation sites. In further examples, 1, 2, or 3 of the N-glycosylation sites corresponding to amino acids N82, N166, N235, N254, N368, and N393 of SEQ ID NO: 107 are fully deglycosylated. In these examples, typically, amino acids N82, N166 or N254 are fully deglycosylated.

Exemplary N-partially glycosylated C-terminally truncated PH20 polypeptides are from any species, such as any set forth in any of SEQ ID NOS: 107-109, 111-120, 197 and 198, or allelic variants or other variants thereof. Allelic variants and other variants are known to one of skill in the art, and include polypeptides having 60%, 70%, 80%, 90%, 91%, 92%, 93%, 94%, 95% or more sequence identity to any of SEQ ID NOS: NOS:107-120, 197 and 198, or truncated forms thereof. The N-partially glycosylated C-terminally truncated PH20 polypeptides provided herein also include hybrid, fusion and chimeric PH20 polypeptides, and PH20 conjugates. For example, the partially deglycosylated C-terminally truncated PH20 polypeptides provided herein can be conjugated to a polymer, such as dextran, a polyethylene glycol (pegylation (PEG)) or sialyl moiety, or other such polymers, such as natural or sugar polymers. In other examples, the N-partially glycosylated C-terminally truncated PH20 polypeptide is linked or fused to a domain such as an Fc domain from an IgG immunoglobulin.

Included amongst the glycosylated or partially glycosylated C-terminally truncated polypeptides provided herein are those that are truncated at the C-terminus by 2 amino acids up to 44 amino acids compared to the wild type PH20 set forth in SEQ ID NO:107 (precursor polypeptide) or 108 (mature polypeptide), or allelic or species variants thereof. Thus, C-terminally truncated PH20 polypeptides include any having C-terminal truncations to generate polypeptides containing amino acid 1 to amino acid 450, 451, 452, 453, 454, 455, 456, 457, 458, 459, 460, 461, 462, 463, 464, 465, 466, 467, 468, 469, 470, 471, 472, 473, 474, 475, 476, 477, 478, 479, 480, 481, 482, 483, 484, 485, 486, 487, 488, 489, 490, 491, 492, 493, 494, 495, 496, 497, 498, 499, 500, 501, 502, 503, 504, 505, 506 or 507 of the sequence of amino acids set forth in SEQ ID NO: 107, or corresponding positions in an allelic or species variant thereof, with 2, 3, 4, 5, or 6 of the N-glycosylation sites, corresponding to amino acids N82, N166, N235, N254, N368, and N393 of SEQ ID NO: 107, glycosylated. When expressed in mammalian cells, the 35 amino acid N-terminal signal sequence is cleaved during processing, and the mature form of the protein is secreted. Thus, provided herein are mature C-terminally truncated PH20 polypeptides that contain amino acids 36 to 450, 451, 452, 453, 454, 455, 456, 457, 458, 459, 460, 461, 462, 463, 464, 465, 466, 467, 468, 469, 470, 471, 472, 473, 474, 475, 476, 477, 478, 479, 480, 481, 482, 483, 484, 485, 486, 487, 488, 489, 490, 491, 492, 493, 494, 495, 496, 497, 498, 499, 500, 501, 502, 503, 504, 505, 506 or 507 of the sequence of amino acids set forth in SEQ ID NO: 107 or corresponding positions in an allelic or species variant thereof, with 3, 4, 5, or 6 of the N-glycosylation sites, corresponding to amino acids N82, N166, N235, N254, N368, and N393 of SEQ ID NO: 107, glycosylated.

Table 2 provides non-limiting examples of exemplary C-terminally truncated PH20 polypeptides that can be glycosylated or partially deglycosylated. In Table 2 below, the length (in amino acids) of the precursor and mature polypeptides, and the sequence identifier (SEQ ID NO) in which exemplary amino acid sequences of the precursor and mature polypeptides of the C-terminally truncated PH20 proteins are set forth, are provided. The wild-type PH20 polypeptide also is included in Table 2 for comparison.

TABLE 2

Exemplary C-terminally truncated PH20 polypeptides

| Polypeptide | Precursor (amino acids) | Precursor SEQ ID NO | Mature (amino acids) | Mature SEQ ID NO |
|---|---|---|---|---|
| SPAM1-VASL | 509 | 1 | 474 | 108 |
| SPAM1-SSVA | 507 | 3 | 472 | 55 |
| SPAM1-ISSV | 506 | 45 | 471 | 97 |
| SPAM1-IISS | 505 | 4 | 470 | 56 |
| SPAM1-LIIS | 504 | 46 | 469 | 98 |
| SPAM1-FLII | 503 | 5 | 468 | 57 |
| SPAM1-LFLI | 502 | 47 | 467 | 99 |
| SPAM1-ILFL | 501 | 6 | 466 | 58 |
| SPAM1-SILF | 500 | 48 | 465 | 100 |
| SPAM1-VSIL | 499 | 7 | 464 | 59 |
| SPAM1-IVSI | 498 | 49 | 463 | 101 |
| SPAM1-FIVS | 497 | 8 | 462 | 60 |
| SPAM1-MFIV | 496 | 50 | 461 | 102 |

TABLE 2-continued

Exemplary C-terminally truncated PH20 polypeptides

| Polypeptide | Precursor (amino acids) | Precursor SEQ ID NO | Mature (amino acids) | Mature SEQ ID NO |
|---|---|---|---|---|
| SPAM1-TMFI | 495 | 9 | 460 | 61 |
| SPAM1-ATMF | 494 | 51 | 459 | 103 |
| SPAM1-SATM | 493 | 10 | 458 | 62 |
| SPAM1-LSAT | 492 | 52 | 457 | 104 |
| SPAM1-TLSA | 491 | 11 | 456 | 63 |
| SPAM1-PSTL | 489 | 12 | 454 | 64 |
| SPAM1-STLS | 490 | 13 | 455 | 65 |
| SPAM1-SPST | 488 | 53 | 453 | 105 |
| SPAM1-ASPS | 487 | 14 | 452 | 66 |
| SPAM1-NASP | 486 | 54 | 451 | 106 |
| SPAM1-YNAS | 485 | 15 | 450 | 67 |
| SPAM1-FYNA | 484 | 16 | 449 | 68 |
| SPAM1-IFYN | 483 | 17 | 448 | 69 |
| SPAM1-QIFY | 482 | 18 | 447 | 70 |
| SPAM1-PQIF | 481 | 19 | 446 | 71 |
| SPAM1-EPQI | 480 | 20 | 445 | 72 |
| SPAM1-EEPQ | 479 | 21 | 444 | 73 |
| SPAM1-TEEP | 478 | 22 | 443 | 74 |
| SPAM1-ETEE | 477 | 23 | 442 | 75 |
| SPAM1-METE | 476 | 24 | 441 | 76 |
| SPAM1-PMET | 475 | 25 | 440 | 77 |
| SPAM1-PPME | 474 | 26 | 439 | 78 |
| SPAM1-KPPM | 473 | 27 | 438 | 79 |
| SPAM1-LKPP | 472 | 28 | 437 | 80 |
| SPAM1-FLKP | 471 | 29 | 436 | 81 |
| SPAM1-AFLK | 470 | 30 | 435 | 82 |
| SPAM1-DAFL | 469 | 31 | 434 | 83 |
| SPAM1-IDAF | 468 | 32 | 433 | 84 |
| SPAM1-CIDA | 467 | 33 | 432 | 85 |
| SPAM1-VCID | 466 | 34 | 431 | 86 |
| SPAM1-GVCI | 465 | 35 | 430 | 87 |
| SPAM1-GDVC | 464 | 36 | 429 | 88 |
| SPAM1-IADG | 462 | 37 | 427 | 89 |
| SPAM1-VCIA | 460 | 38 | 425 | 90 |
| SPAM1-VDVC | 458 | 39 | 423 | 91 |
| SPAM1-DAVD | 456 | 40 | 421 | 92 |
| SPAM1-DTDA | 454 | 41 | 419 | 93 |
| SPAM1-VKDT | 452 | 42 | 417 | 94 |
| SPAM1-ADVK | 450 | 43 | 415 | 95 |

The N-glycosylated and partially deglycosylated C-terminal truncated PH20 polypeptides provided herein include those that are soluble, i.e. partition into the aqueous phase of a Triton® X-114 solution, and those that are insoluble, i.e. partition into the detergent phase of a Triton® X-114 solution. The partially deglycosylated C-terminally truncated PH20 polypeptides provided herein can have 10%, 20%, 30%, 40%, 50%, 60%, 70% or 80% of the level of glycosylation of a fully glycosylated hyaluronidase. Alternatively, the partially deglycosylated C-terminal truncated PH20 polypeptides can have 1, 2 or 3 of the N-glycosylation sites, corresponding to amino acids N82, N166 and N254 of SEQ ID NO: 107, that are not glycosylated. Minimally, to be glycosylated, an N-glycosylation site contains at least an N-acetylglucosamine moiety.

In some examples, the N-partially glycosylated C-terminally truncated polypeptides provided herein are soluble, i.e., are not GPI-anchored. This can be assessed, for example, using a Triton® X-114 assay following incubation with PI-PLC or PI-PLD, as described below and in Example 4. For example, PH20 polypeptides that are C-terminally truncated at or 5' to the amino acid position corresponding to amino acid residue position 490 of the PH20 polypeptide set forth in SEQ ID NO:107 typically are soluble when expressed in a mammalian expression system (see, e.g. Example 3). These polypeptides are soluble by virtue of the fact that they completely lack the GPI-anchor attachment signal sequence. In other examples, the partially glycosylated C-terminally truncated polypeptides provided herein are insoluble and membrane-bound when expressed in a mammalian expression system. For example, PH20 polypeptides that are C-terminally truncated at or 3' of the amino acid position corresponding to amino acid position 500 of the PH20 polypeptide set forth in SEQ ID NO:107 typically are insoluble when expressed in a mammalian expression system (see, e.g. Example 3). The C-terminally truncated polypeptides provided herein can be partially glycosylated in that 3, 4, 5, or 6 of the N-glycosylation sites corresponding to amino acids N82, N166, N235, N254, N368, and N393 of SEQ ID NO: 107 are glycosylated.

Soluble partially glycosylated C-terminal truncated PH20 polypeptides provided herein include those that are truncated but retain at least one or more amino acid residues located in the GPI-anchor attachment signal, and those that completely lack the GPI-anchor attachment signal sequence and the ω-site. Thus, instead of having a GPI-anchor covalently attached to the C-terminus of the protein in the ER and being anchored to the extracellular leaflet of the plasma membrane, these polypeptides are secreted. These C-terminal truncated soluble PH20 polypeptides can be partially glycosylated such that 3, 4, 5, or 6 of the N-glycosylation sites are glycosylated. Exemplary soluble C-terminally truncated PH20 polypeptides that lack the GPI-anchor attachment signal sequence are from any species, such as any set forth in any of SEQ ID NOS: 107-109, 111-120, 197 and 198, or allelic variants or other variants thereof. These partially glycosylated soluble C-terminal truncated PH20 polypeptides have C-terminal truncations to generate polypeptides containing amino acids 1 to 450, 451, 452, 453, 454, 455, 456, 457, 458, 459, 460, 461, 462, 463, 464, 465, 466, 467, 468, 469, 470, 471, 472, 473, 474, 475, 476, 477, 478, 479, 480, 481, 482, 483, 484, 485, 486, 487, 488, 489, 490, 491, 492, 493, 494, 495, 496, 497, 498, 499 or 500 of the sequence of amino acids set forth in SEQ ID NO: 107. Upon cleavage of the N-terminal signal sequence following expression in mammalian cells, the mature partially glycosylated soluble C-terminal truncated PH20 polypeptides polypeptides contain amino acids 36 to 450, 451, 452, 453, 454, 455, 456, 457, 458, 459, 460, 461, 462, 463, 464, 465, 466, 467, 468, 469, 470, 471, 472, 473, 474, 475, 476, 477, 478, 479, 480, 481, 482, 483, 484, 485, 486, 487, 488, 489, 490, 491, 492, 493, 494, 495, 496, 497, 498, 499 or 500 of the sequence of amino acids set forth in SEQ ID NO: 107. In some examples, the C-terminally GPI-anchor signal sequence truncated soluble PH20 polypeptides are partially glycosylated, containing, for example, at least an N-acetylglucosamine at 3, 4, 5, or 6 of the N-glycosylation sites corresponding to amino acids N82, N166, N235, N254, N368, and N393 of SEQ ID NO: 107. In other examples, the C-terminally GPI-anchor signal sequence truncated soluble PH20 polypeptides have 10%, 20%, 30%, 40%, 50%, 60%, 70% or 80% of the level of glycosylation of a fully glycosylated hyaluronidase.

Partially deglycosylated C-terminal truncated PH20 polypeptides that retain at least one amino acid in the GPI-anchor attachment signal sequence provided herein are partially deglycosylated extended soluble PH20 polypeptides. In some examples, the partially deglycosylated C-terminal truncated PH20 polypeptides are not glycosylated at 1, 2 or 3 of the N-glycosylation sites corresponding to amino acids N82, N166 and N254 of SEQ ID NO: 107. These partially deglycosylated extended soluble PH20 polypeptides contain amino acids 1 to 491, 492, 493, 494, 495, 496, 497, 498, 499 or 500 of the sequence of amino acids set forth in SEQ ID NO: 107. When expressed in mammalian cells, the 35 amino acid N-terminal signal sequence is cleaved during processing, and the mature form of the protein is secreted. Thus, the mature form of the partially deglycosylated esPH20 polypeptides contain amino acids 36 to 491, 492, 493, 494, 495, 496, 497, 498, 499 or 500 of the sequence of amino acids set forth in SEQ ID NO: 107. Mature human forms of partially glycosylated esPH20 polypeptides provided herein include those set forth in SEQ ID NOS: 59-63 and 100-104 containing at least an N-acetylglucosamine at 3, 4, 5 or 6 of the N-glycosylation sites corresponding to amino acids N82, N166, N235, N254, N368, and N393 of SEQ ID NO: 107. In some examples, the extent of glycosylation is reduced by treatment with a endoglycosidase. Thus, the partially deglycosylated C-terminally truncated PH20 polypeptides that contain at least one amino acid in the GPI-anchor attachment signal sequence provided herein can have 10%, 20%, 30%, 40%, 50%, 60%, 70% or 80% of the level of glycosylation of a fully glycosylated hyaluronidase.

Also provided herein are partially deglycosylated C-terminally truncated PH20 polypeptides that are not soluble, that is, they are attached to the cell membrane and therefore not secreted into the media upon expression. The C-terminal truncated PH20 polypeptides that are not soluble can be partially deglycosylated as long as they retain hyaluronidase activity. Exemplary partially glycosylated mature C-terminally truncated PH20 polypeptides that are not soluble are those that contain amino acids corresponding to amino acid positions 36 to 501, 502, 503, 504, 505, 506 or 507 of SEQ ID NO:107. Hence, partially glycosylated C-terminally truncated PH20 polypeptides provided herein that are not soluble include those that are 466, 467, 468, 469, 470, 471 or 472 amino acids in length, such as those set forth in SEQ ID NOS: 55-58 and 97-99, that retain at least 10%, 20%, 30%, 40%, 50%, 60%, 70% or 80% of the level of glycosylation of a fully glycosylated hyaluronidase. In some examples, 3, 4, 5, or 6 of the N-glycosylation sites corresponding to amino acids N82, N166, N235, N254, N368, and N393 of SEQ ID NO: 107 are glycosylated. In other examples, the 1, 2, 3, 4, 5 or 6 of the N-glycosylation sites, corresponding to amino acids N82, N166, N235, N254, N368, and N393 of SEQ ID NO: 107, contain at least an N-acetylglucosamine moiety.

The partially glycosylated C-terminally truncated polypeptides provided herein can exhibit hyaluronidase activity that is increased or decreased compared to the wild-type GPI-anchored form of the PH20. Additionally, the partially deglycosylated C-terminally truncated PH20 polypeptides are neutral active, that is, they retain hyaluronidase activity at neutral pH. For example, the C-terminal truncated PH20 polypeptides provided herein can exhibit hyaluronidase activity that is 1%, 10%, 20%, 30%, 40%, 50%, 60%, 70%, 80%, 90%, 100%, 110%, 120%, 130%, 140%, 150%, 200%, 300%, 400%, 500%, 1000% or more of the hyaluronidase activity exhibited by the wildtype GPI-anchored form. In some examples, partially glycosylated C-terminal truncated PH20 polypeptides exhibit increased hyaluronidase activity compared to the wildtype GPI-anchored form.

The C-terminal truncated PH20 polypeptides provided herein may also be N-glycosylated. The N-glycosylated and N-partially glycosylated hyaluronidases provided herein also include hybrid, fusion and chimeric N-glycosylated and partially deglycosylated hyaluronidases, and N-glycosylated and partially deglycosylated hyaluronidase conjugates.

3. Additional Modifications

The PH20 polypeptides included herein, including human esPH20 polypeptides, N-glycosylated and N-partially glycosylated C-terminally truncated PH20 polypeptides and partially glycosylated PH20 polypeptides, also include those that contain chemical or posttranslational modifications and those that do not contain chemical or posttranslational modifications. Such modifications include, but are not limited to, pegylation, sialation, albumination, glycosylation, farnysylation, carboxylation, hydroxylation, phosphorylation, and other polypeptide modifications known in the art. Thus, C-terminally truncated PH20 polypeptides, including esPH20 polypeptides, provided herein can contain other modifications that are or are not in the primary sequence of the polypeptide, including, but not limited to, of a carbohydrate moiety, a polyethylene glycol (PEG) moiety, a silation moiety, an Fc domain from immunoglobulin G, or any other domain or moiety. For example, such additional modifications can be made to increase the stability or serum half-life of the protein. The C-terminally truncated PH20 polypeptides, including esPH20 polypeptides, provided herein can be conjugated or fused to any moiety using any method known in the art, including chemical and recombinant methods, providing the resulting polypeptide retains hyaluronidase activity.

Decreased Immunogenicity

The PH20 polypeptides provided herein, including the human esPH20 polypeptides, can be made to have decreased immunogenicity. Decreased immunogenicity can be effected by sequence changes that eliminate antigenic epitopes from the polypeptide or by altering post-translational modifications. For example, altering the glycosylation of the peptide is contemplated, so long as the polypeptides minimally contain at least N-acetylglucosamine at amino acid residues N235, N368 and N393 of SEQ ID NO:107.

For example, the PH20 polypeptides can be modified such that they lack fucose, particularly bifucosylation. In particular, the PH20 polypeptides provided herein are not bifucosylated. This can be achieved by expressing and producing the PH20 polypeptide in a host cells, typically insect host cells, that do not effect bifucosylation. Fucose is a deoxyhexose that is present in a wide variety of organisms, including mammals, insects and plants. Fucosylated glycans are synthesized by fucosyl-tranferases. See, e.g., Ma et al., *Glycobiology*, 15 (2):158R-184R, (2006); Nakayama et al., *J. Biol. Chem.*, 276:16100-16106 (2001); and Sturla et al., *Glycobiology*, 15 (10):924-935 (2005). In humans, fucose frequently exists as a terminal modification to glycan structures, and the presence of fucose α1,6-linked to N-acetylglucosamine has been shown to be important in glycoprotein processing and recognition. In insects, N-glycan core structures exhibit bifucosylation with α1,6- and α1,3-linkages. Insect cell core fucosylation with α1,3-linkages generates a carbohydrate epitope that is immunogenic in humans (see, e.g., US Patent Application No. 20070067855). For example, PH20 polypeptides provided herein, including esPH20 polypeptides, can be generated in host cells that are incapable of bifucosylating the polypeptide. Thus, while insect cells or other cells that bifucosylate can be used for expression of the polypeptides, typically mammalian cells, such as CHO cells, are used.

In some examples, defucosylated, or fucose-deficient PH20 polypeptides can be generated in insect cells with modified glycosylation pathways, through the use of baculovirus expression vectors containing eukaryotic oligosaccharide processing genes, thereby creating "mammalianized" insect cell expression systems (see, e.g., U.S. Pat. No. 6,461, 863). Alternatively, antigenicity can be eliminated by expression of PH20 polypeptides in insect cells lacking α1,3-fucosyltransferase (FT3) (see, e.g., US Patent Application No. 20070067855). In other examples, defucosylated or fucose-deficient PH20 polypeptides can be generated, for example, in cell lines that produce defucosylated proteins, including Lec13 CHO cells deficient in protein fucosylation (Ripka et al. *Arch. Biochem. Biophys.* 249:533-545 (1986); U.S. Pat. Appl. No. 2003/0157108; and WO 2004/056312), and knockout cell lines, such as alpha-1,6-fucosyltransferase gene, FUT8, knockout CHO cells (Yamane-Ohnuki et al. *Biotech. Bioeng.* 87: 614 (2004)).

Conjugation to Polymers

In some examples, the esPH20 polypeptides and other C-terminally truncated PH20 polypeptides, including partially glycosylated PH20 polypeptides, provided herein are conjugated to polymers. Exemplary polymers that can be conjugated to the PH20 polypeptides, include natural and synthetic homopolymers, such as polyols (i.e. poly-OH), polyamines (i.e. poly-$NH_2$) and polycarboxylic acids (i.e. poly-COOH), and further heteropolymers i.e. polymers comprising one or more different coupling groups e.g. a hydroxyl group and amine groups. Examples of suitable polymeric molecules include polymeric molecules selected from among polyalkylene oxides (PAO), such as polyalkylene glycols (PAG), including polyethylene glycols (PEG), methoxypolyethylene glycols (mPEG) and polypropylene glycols, PEG-glycidyl ethers (Epox-PEG), PEG-oxycarbonylimidazole (CDI-PEG), branched polyethylene glycols (PEGs), polyvinyl alcohol (PVA), polycarboxylates, polyvinylpyrrolidone, poly-D,L-amino acids, polyethylene-co-maleic acid anhydride, polystyrene-co-maleic acid anhydride, dextrans including carboxymethyl-dextrans, heparin, homologous albumin, celluloses, including methylcellulose, carboxymethylcellulose, ethylcellulose, hydroxyethylcellulose, carboxyethylcellulose and hydroxypropylcellulose, hydrolysates of chitosan, starches such as hydroxyethyl-starches and hydroxypropyl-starches, glycogen, agaroses and derivatives thereof, guar gum, pullulan, inulin, xanthan gum, carrageenan, pectin, alginic acid hydrolysates and bio-polymers.

Typically, the polymers are polyalkylene oxides (PAO), such as polyethylene oxides, such as PEG, typically mPEG, which, in comparison to polysaccharides such as dextran, pullulan and the like, have few reactive groups capable of cross-linking. Typically, the polymers are non-toxic polymeric molecules such as (methoxy)polyethylene glycol (mPEG) which can be covalently conjugated to the esPH20 polypeptides and other C-terminally truncated PH20 polypeptides (e.g., to attachment groups on the protein surface) using a relatively simple chemistry.

Suitable polymeric molecules for attachment to the esPH20 polypeptides and other C-terminally truncated PH20 polypeptides include, but are not limited to, polyethylene glycol (PEG) and PEG derivatives such as methoxy-polyethylene glycols (mPEG), PEG-glycidyl ethers (Epox-PEG), PEG-oxycarbonylimidazole (CDI-PEG), branched PEGs, and polyethylene oxide (PEO) (see e.g. Roberts et al., *Advanced Drug Delivery Review* 2002, 54: 459-476; Harris and Zalipsky (eds.) "Poly(ethylene glycol), Chemistry and Biological Applications" ACS Symposium Series 680, 1997; Mehvar et al., *J. Pharm. Pharmaceut. Sci.*, 3 (1):125-136, 2000; Harris and Chess (2003) *Nat Rev Drug Discov.* 2 (3): 214-21; and Tsubery, *J Biol. Chem.* 279 (37):38118-24, 2004). The polymeric molecule can be of a molecular weight typically ranging from about 3 kDa to about 60 kDa. In some embodiments the polymeric molecule that is conjugated to a PH20 polypeptide provided herein has a molecular weight of 5, 10, 15, 20, 25, 30, 35, 40, 45, 50, 55, 60 or more than 60 kDa.

Various methods of modifying polypeptides by covalently attaching (conjugating) a PEG or PEG derivative (i.e. "PEGylation") are known in the art (see e.g., U.S. 2006/0104968; U.S. Pat. No. 5,672,662; U.S. Pat. No. 6,737,505; and U.S.

2004/0235734). Techniques for PEGylation include, but are not limited to, specialized linkers and coupling chemistries (see e.g., Harris, *Adv. Drug Deliv. Rev.* 54:459-476, 2002), attachment of multiple PEG moieties to a single conjugation site (such as via use of branched PEGs; see e.g., Veronese et al., *Bioorg. Med. Chem. Lett.* 12:177-180, 2002), site-specific PEGylation and/or mono-PEGylation (see e.g., Chapman et al., Nature Biotech. 17:780-783, 1999), and site-directed enzymatic PEGylation (see e.g., Sato, *Adv. Drug Deliv. Rev.*, 54:487-504, 2002) (see, also, for example, Lu and Felix (1994) *Int. J. Peptide Protein Res.* 43:127-138; Lu and Felix (1993) *Peptide Res.* 6:142-6, 1993; Felix et al. (1995) *Int. J. Peptide Res.* 46:253-64; Benhar et al. (1994) *J. Biol. Chem.* 269:13398-404; Brumeanu et al. (1995) *J Immunol.* 154: 3088-95; see also, Caliceti et al. (2003) *Adv. Drug Deliv. Rev.* 55(10):1261-77 and Molineux (2003) *Pharmacotherapy* 23 (8 Pt 2):3S-8S). Methods and techniques described in the art can produce proteins having 1, 2, 3, 4, 5, 6, 7, 8, 9, 10 or more than 10 PEG or PEG derivatives attached to a single protein molecule (see e.g., U.S. 2006/0104968).

Numerous reagents for PEGylation have been described in the art. Such reagents include, but are not limited to, N-hydroxysuccinimidyl (NHS) activated PEG, succinimidyl mPEG, mPEG2-N-hydroxysuccinimide, mPEG succinimidyl alpha-methylbutanoate, mPEG succinimidyl propionate, mPEG succinimidyl butanoate, mPEG carboxymethyl 3-hydroxybutanoic acid succinimidyl ester, homobifunctional PEG-succinimidyl propionate, homobifunctional PEG propionaldehyde, homobifunctional PEG butyraldehyde, PEG maleimide, PEG hydrazide, p-nitrophenyl-carbonate PEG, mPEG-benzotriazole carbonate, propionaldehyde PEG, mPEG butryaldehyde, branched mPEG2 butyraldehyde, mPEG acetyl, mPEG piperidone, mPEG methylketone, mPEG "linkerless" maleimide, mPEG vinyl sulfone, mPEG thiol, mPEG orthopyridylthioester, mPEG orthopyridyl disulfide, Fmoc-PEG-NHS, Boc-PEG-NHS, vinylsulfone PEG-NHS, acrylate PEG-NHS, fluorescein PEG-NHS, and biotin PEG-NHS (see e.g., Monfardini et al., Bioconjugate Chem. 6:62-69, 1995; Veronese et al., *J. Bioactive Compatible Polymers* 12:197-207, 1997; U.S. Pat. No. 5,672,662; U.S. Pat. No. 5,932,462; U.S. Pat. No. 6,495,659; U.S. Pat. No. 6,737,505; U.S. Pat. No. 4,002,531; U.S. Pat. No. 4,179,337; U.S. Pat. No. 5,122,614; U.S. Pat. No. 5,183,550; U.S. Pat. No. 5,324,844; U.S. Pat. No. 5,446,090; U.S. Pat. No. 5,612,460; U.S. Pat. No. 5,643,575; U.S. Pat. No. 5,766,581; U.S. Pat. No. 5,795,569; U.S. Pat. No. 5,808,096; U.S. Pat. No. 5,900,461; U.S. Pat. No. 5,919,455; U.S. Pat. No. 5,985,263; U.S. Pat. No. 5,990,237; U.S. Pat. No. 6,113,906; U.S. Pat. No. 6,214,966; U.S. Pat. No. 6,258,351; U.S. Pat. No. 6,340,742; U.S. Pat. No. 6,413,507; U.S. Pat. No. 6,420,339; U.S. Pat. No. 6,437,025; U.S. Pat. No. 6,448,369; U.S. Pat. No. 6,461,802; U.S. Pat. No. 6,828,401; U.S. Pat. No. 6,858,736; U.S. 2001/0021763; U.S. 2001/0044526; U.S. 2001/0046481; U.S. 2002/0052430; U.S. 2002/0072573; U.S. 2002/0156047; U.S. 2003/0114647; U.S. 2003/0143596; U.S. 2003/0158333; U.S. 2003/0220447; U.S. 2004/0013637; US 2004/0235734; U.S. 2005/000360; U.S. 2005/0114037; U.S. 2005/0171328; U.S. 2005/0209416; EP 01064951; EP 0822199; WO 00176640; WO 0002017; WO 0249673; WO 9428024; and WO 0187925).

Other Modifications

The esPH20 polypeptides and other C-terminally truncated PH20 polypeptides provided herein also include fusions and conjugates thereof.

E. Methods of Producing Nucleic Acids Encoding Extended Soluble PH20 and Other Soluble PH20 Hyaluronidases, and Polypeptides Thereof Polypeptides of extended soluble PH20, C-terminal truncated PH20 hyaluronidases, and partially glycosylated PH20 hyaluronidases set forth herein, and nucleic acid molecules encoding such polypeptides, can be obtained by methods well known in the art for recombinant protein expression and protein purification. For example, the DNA can be obtained from cloned DNA (e.g. from a DNA library), by chemical synthesis, by cDNA cloning, or by the cloning of genomic DNA or fragments thereof, purified from the desired cell. When the polypeptides are produced by recombinant means, any method known to those of skill in the art for identification of nucleic acids that encode desired genes can be used. Any method available in the art can be used to obtain a full length (i.e. encompassing the entire coding region) cDNA or genomic DNA encoding a desired PH20 enzyme, such as from a cell or tissue source. Modified or variant, including truncated forms such as provided herein, can be engineered from a wildtype polypeptide using standard recombinant DNA methods.

Polypeptides can be cloned or isolated using any available methods known in the art for cloning and isolating nucleic acid molecules. Such methods include PCR amplification of nucleic acids and screening of libraries, including nucleic acid hybridization screening, antibody-based screening and activity-based screening.

Methods for amplification of nucleic acids can be used to isolate nucleic acid molecules encoding a desired polypeptide, including for example, polymerase chain reaction (PCR) methods. PCR can be carried out using any known methods or procedures in the art. Exemplary of such methods include use of a Perkin-Elmer Cetus thermal cycler and Taq polymerase (Gene Amp). A nucleic acid containing material can be used as a starting material from which a desired polypeptide-encoding nucleic acid molecule can be isolated. For example, DNA and mRNA preparations, cell extracts, tissue extracts from an appropriate source (e.g. testis, prostate, breast), fluid samples (e.g. blood, serum, saliva), samples from healthy and/or diseased subjects can be used in amplification methods. The source can be from any eukaryotic species including, but not limited to, vertebrate, mammalian, human, porcine, bovine, feline, avian, equine, canine, and other primate sources. Nucleic acid libraries also can be used as a source of starting material. Primers can be designed to amplify a desired polypeptide. For example, primers can be designed based on expressed sequences from which a desired polypeptide is generated. Primers can be designed based on back-translation of a polypeptide amino acid sequence. If desired, degenerate primers can be used for amplification. Oligonucleotide primers that hybridize to sequences at the 3' and 5' termini of the desired sequence can be uses as primers to amplify by PCR sequences from a nucleic acid sample. Primers can be used to amplify the entire full-length PH20, or a truncated sequence thereof, such as a nucleic acid encoding any of the soluble PH20 polypeptides provided herein. Nucleic acid molecules generated by amplification can be sequenced and confirmed to encode a desired polypeptide.

Additional nucleotide sequences can be joined to a polypeptide-encoding nucleic acid molecule, including linker sequences containing restriction endonuclease sites for the purpose of cloning the synthetic gene into a vector, for example, a protein expression vector or a vector designed for the amplification of the core protein coding DNA sequences. Furthermore, additional nucleotide sequences specifying functional DNA elements can be operatively linked to a polypeptide-encoding nucleic acid molecule. Examples of such sequences include, but are not limited to, promoter sequences designed to facilitate intracellular protein expression, and secretion sequences, for example heterologous signal sequences, designed to facilitate protein secretion. Such sequences are known to those of skill in the art. For example, exemplary heterologous signal sequences include, but are not limited to, human and mouse kappa IgG heterologous signal sequences set forth in SEQ ID NOS:144 and 145, respectively. Additional nucleotide residues sequences such as sequences of bases specifying protein binding regions also can be linked to enzyme-encoding nucleic acid molecules. Such regions include, but are not limited to, sequences of residues that facilitate or encode proteins that facilitate uptake of an enzyme into specific target cells, or otherwise alter pharmacokinetics of a product of a synthetic gene.

In addition, tags or other moieties can be added, for example, to aid in detection or affinity purification of the polypeptide. For example, additional nucleotide residues sequences such as sequences of bases specifying an epitope tag or other detectable marker also can be linked to enzyme-encoding nucleic acid molecules. Exemplary of such sequences include nucleic acid sequences encoding a His tag (e.g., 6×His, HHHHHH; SEQ ID NO:142) or Flag Tag (DYKDDDDK; SEQ ID NO:143).

The identified and isolated nucleic acids can then be inserted into an appropriate cloning vector. A large number of vector-host systems known in the art can be used. Possible vectors include, but are not limited to, plasmids or modified viruses, but the vector system must be compatible with the host cell used. Such vectors include, but are not limited to, bacteriophage such as lambda derivatives, or plasmids such as pCMV4, pBR322 or pUC plasmid derivatives or the Bluescript vector (Stratagene, La Jolla, Calif.). Other expression vectors include the HZ24 expression vector exemplified herein (set forth in SEQ ID NO:140). The insertion into a cloning vector can, for example, be accomplished by ligating the DNA fragment into a cloning vector which has complementary cohesive termini. If the complementary restriction sites used to fragment the DNA are not present in the cloning vector, the ends of the DNA molecules can be enzymatically modified. Alternatively, any site desired can be produced by ligating nucleotide sequences (linkers) onto the DNA termini; these ligated linkers can include specific chemically synthesized oligonucleotides encoding restriction endonuclease recognition sequences. In an alternative method, the cleaved vector and protein gene can be modified by homopolymeric tailing. Insertion can be effected using TOPO cloning vectors (INVITROGEN, Carlsbad, Calif.).

Recombinant molecules can be introduced into host cells via, for example, transformation, transfection, infection, electroporation and sonoporation, so that many copies of the gene sequence are generated. In specific embodiments, transformation of host cells with recombinant DNA molecules that incorporate the isolated protein gene, cDNA, or synthesized DNA sequence enables generation of multiple copies of the gene. Thus, the gene can be obtained in large quantities by growing transformants, isolating the recombinant DNA molecules from the transformants and, when necessary, retrieving the inserted gene from the isolated recombinant DNA.

In addition to recombinant production, soluble PH20, including any esPH20 provided herein, can be produced by direct peptide synthesis using solid-phase techniques (see e.g., Stewart et al. (1969) *Solid-Phase Peptide Synthesis*, WH Freeman Co., San Francisco; Merrifield J (1963) *J Am Chem. Soc.*, 85:2149-2154). In vitro protein synthesis can be performed using manual techniques or by automation. Automated synthesis can be achieved, for example, using Applied Biosystems 431A Peptide Synthesizer (Perkin Elmer, Foster City Calif.) in accordance with the instructions provided by the manufacturer. Various fragments of a polypeptide can be chemically synthesized separately and combined using chemical methods.

1. Vectors and Cells

For recombinant expression of one or more of the desired proteins, such as any described herein, the nucleic acid containing all or a portion of the nucleotide sequence encoding the protein can be inserted into an appropriate expression vector, i.e., a vector that contains the necessary elements for the transcription and translation of the inserted protein coding sequence. The necessary transcriptional and translational signals also can be supplied by the native promoter for PH20 genes, and/or their flanking regions.

Also provided are vectors that contain a nucleic acid encoding the enzyme. Cells containing the vectors also are provided. The cells include eukaryotic and prokaryotic cells, and the vectors are any suitable for use therein.

Prokaryotic and eukaryotic cells, including endothelial cells, containing the vectors are provided. Such cells include bacterial cells, yeast cells, fungal cells, Archea, plant cells, insect cells and animal cells. The cells are used to produce a protein thereof by growing the above-described cells under conditions whereby the encoded protein is expressed by the cell, and recovering the expressed protein. For purposes herein, for example, soluble PH20 polypeptides, including extended soluble PH20 polypeptides, can be secreted into the medium.

A host cells strain can be chosen for its ability to modulate the expression of the inserted sequences or to process the expressed protein in the desired fashion. Such modifications of the polypeptide include, but are not limited to, acetylation, carboxylation, glycosylation, phosphorylation, lipidation and acylation. Posttranslational processing can impact the folding and/or function of the polypeptide. Different host cells, such as, but not limited to, CHO (DG44, DXB11, CHO-K1), HeLa, MCDK, 293 and WI38 have specific cellular machinery and characteristic mechanisms for such post-translational activities and can be chosen to ensure the correct modification and processing of the introduced protein. Generally, the choice of cell is one that is capable of introducing N-linked glycosylation into the expressed polypeptide. Hence, eukaryotic cells containing the vectors are provided. Exemplary of eukaryotic cells are mammalian Chinese Hamster Ovary (CHO) cells. For example, CHO cells deficient in dihydrofolate reductase (e.g. DG44 cells) are used to produce polypeptides provided herein. Note that bacterial expression of an extended soluble PH20 or C-terminally truncated PH20 provided herein will not result in a catalytically active polypeptide, but when combined with proper glycosylation machinery, the PH20 can be artificially glycosylated.

Provided are vectors that contain a sequence of nucleotides that encodes the hyaluronidase polypeptide, including extended soluble PH20 polypeptides and other C-terminal truncated PH20 polypeptides, coupled to the native or heterologous signal sequence, as well as multiple copies thereof. The vectors can be selected for expression of the enzyme protein in the cell or such that the enzyme protein is expressed as a secreted protein.

A variety of host-vector systems can be used to express the protein coding sequence. These include but are not limited to mammalian cell systems infected with virus (e.g. vaccinia virus, adenovirus and other viruses); insect cell systems infected with virus (e.g. baculovirus); microorganisms such as yeast containing yeast vectors; or bacteria transformed with bacteriophage, DNA, plasmid DNA, or cosmid DNA. The expression elements of vectors vary in their strengths and specificities. Depending on the host-vector system used, any one of a number of suitable transcription and translation elements can be used.

Any methods known to those of skill in the art for the insertion of DNA fragments into a vector can be used to construct expression vectors containing a chimeric gene containing appropriate transcriptional/translational control signals and protein coding sequences. These methods can include in vitro recombinant DNA and synthetic techniques and in vivo recombinants (genetic recombination). Expression of nucleic acid sequences encoding protein, or domains, derivatives, fragments or homologs thereof, can be regulated by a second nucleic acid sequence so that the genes or fragments thereof are expressed in a host transformed with the recombinant DNA molecule(s). For example, expression of the proteins can be controlled by any promoter/enhancer known in the art. In a specific embodiment, the promoter is not native to the genes for a desired protein. Promoters which can be used include but are not limited to the SV40 early promoter (Bernoist and Chambon, *Nature* 290:304-310 (1981)), the promoter contained in the 3' long terminal repeat of Rous sarcoma virus (Yamamoto et al. *Cell* 22:787-797 (1980)), the herpes thymidine kinase promoter (Wagner et al., *Proc. Natl. Acad. Sci. USA* 78:1441-1445 (1981)), the regulatory sequences of the metallothionein gene (Brinster et al., *Nature* 296:39-42 (1982)); prokaryotic expression vectors such as the b-lactamase promoter (Jay et al., (1981) *Proc. Natl. Acad. Sci. USA* 78:5543) or the tac promoter (DeBoer et al., *Proc. Natl. Acad. Sci. USA* 80:21-25 (1983)); see also "Useful Proteins from Recombinant Bacteria": in Scientific American 242:79-94 (1980)); plant expression vectors containing the nopaline synthase promoter (Herrara-Estrella et al., *Nature* 303:209-213 (1984)) or the cauliflower mosaic virus 35S RNA promoter (Gardner et al., *Nucleic Acids Res.* 9:2871 (1981)), and the promoter of the photosynthetic enzyme ribulose bisphosphate carboxylase (Herrera-Estrella et al., *Nature* 310:115-120 (1984)); promoter elements from yeast and other fungi such as the Gal4 promoter, the alcohol dehydrogenase promoter, the phosphoglycerol kinase promoter, the alkaline phosphatase promoter, and the following animal transcriptional control regions that exhibit tissue specificity and have been used in transgenic animals: elastase I gene control region which is active in pancreatic acinar cells (Swift et al., *Cell* 38:639-646 (1984); Ornitz et al., *Cold Spring Harbor Symp. Quant. Biol.* 50:399-409 (1986); Macponald, *Hepatology* 7:425-515 (1987)); insulin gene control region which is active in pancreatic beta cells (Hanahan et al., *Nature* 315:115-122 (1985)), immunoglobulin gene control region which is active in lymphoid cells (Grosschedl et al., *Cell* 38:647-658 (1984); Adams et al., *Nature* 318:533-538 (1985); Alexander et al., *Mol. Cell. Biol.* 7:1436-1444 (1987)), mouse mammary tumor virus control region which is active in testicular, breast, lymphoid and mast cells (Leder et al., *Cell* 45:485-495 (1986)), albumin gene control region which is active in liver (Pinckert et al., *Genes and Devel.* 1:268-276 (1987)), alpha-fetoprotein gene control region which is active in liver (Krumlauf et al., *Mol. Cell. Biol.* 5:1639-1648 (1985); Hammer et al., *Science* 235:53-58 1987)), alpha-1 antitrypsin gene control region which is active in liver (Kelsey et al., *Genes and Devel.* 1:161-171 (1987)), beta globin gene control region which is active in myeloid cells (Magram et al., *Nature* 315:338-340 (1985); Kollias et al., *Cell* 46:89-94 (1986)), myelin basic protein gene control region which is active in oligodendrocyte cells of the brain (Readhead et al., *Cell* 48:703-712 (1987)), myosin light chain-2 gene control region which is active in skeletal muscle (Shani, *Nature* 314:283-286 (1985)), and gonadotrophic releasing hormone gene control region which is active in gonadotrophs of the hypothalamus (Mason et al., *Science* 234:1372-1378 (1986)).

In a specific embodiment, a vector is used that contains a promoter operably linked to nucleic acids encoding a PH20 protein, or a domain, fragment, derivative or homolog, thereof, one or more origins of replication, and optionally, one or more selectable markers (e.g., an antibiotic resistance gene). Depending on the expression system, specific initiation signals also are required for efficient translation of a PH20 sequence. These signals include the ATG initiation codon and adjacent sequences. In cases where the initiation codon and upstream sequences of PH20 or soluble forms thereof are inserted into the appropriate expression vector, no additional translational control signals are needed. In cases where only coding sequence, or a portion thereof, is inserted, exogenous transcriptional control signals including the ATG initiation codon must be provided. Furthermore, the initiation codon must be in the correct reading frame to ensure transcription of the entire insert. Exogenous transcriptional elements and initiation codons can be of various origins, both natural and synthetic. The efficiency of expression can be enhanced by the inclusion of enhancers appropriate to the cell system in use (Scharf et al. (1994) *Results Probl Cell Differ* 20:125-62; Bittner et al. (1987) *Methods in Enzymol,* 153: 516-544).

Exemplary plasmid vectors for transformation of *E. coli* cells, include, for example, the pQE expression vectors (available from Qiagen, Valencia, Calif.; see also literature published by Qiagen describing the system). pQE vectors have a phage T5 promoter (recognized by *E. coli* RNA polymerase) and a double lac operator repression module to provide tightly regulated, high-level expression of recombinant proteins in *E. coli*, a synthetic ribosomal binding site (RBS II) for efficient translation, a 6×His tag coding sequence, tand T1 transcriptional terminators, ColE1 origin of replication, and a beta-lactamase gene for conferring ampicillin resistance. The pQE vectors enable placement of a 6×His tag at either the N- or C-terminus of the recombinant protein. Such plasmids include pQE 32, pQE 30, and pQE 31 which provide multiple cloning sites for all three reading frames and provide for the expression of N-terminally 6×His-tagged proteins. Other exemplary plasmid vectors for transformation of *E. coli* cells, include, for example, the pET expression vectors (see, U.S. Pat. No. 4,952,496; available from NOVAGEN, Madison, Wis.; see, also literature published by Novagen describing the system). Such plasmids include pET 11a, which contains the T7lac promoter, T7 terminator, the inducible *E. coli* lac operator, and the lac repressor gene; pET 12a-c, which contains the T7 promoter, T7 terminator, and the *E. coli* ompT secretion signal; and pET 15b and pET19b (NOVAGEN, Madison, Wis.), which contain a His-Tag™ leader sequence for use in purification with a His column and a thrombin cleavage site that permits cleavage following purification over the column, the T7-lac promoter region and the T7 terminator.

Exemplary of a vector for mammalian cell expression is the HZ24 expression vector. The HZ24 expression vector was derived from the pCI vector backbone (Promega). It contains DNA encoding the Beta-lactamase resistance gene (AmpR), an F1 origin of replication, a Cytomegalovirus immediate-early enhancer/promoter region (CMV), and an SV40 late polyadenylation signal (SV40). The expression vector also has an internal ribosome entry site (IRES) from the ECMV virus (Clontech) and the mouse dihydrofolate reductase (DHFR) gene. Cells transfected with such a vector can be cultured in chemically defined medium in the absence of hypoxanthine and thymidine, followed by further gene amplification with increasing concentrations of methotrexate. Such methods are described herein in Examples 13 and 15.

2. Expression

PH20 polypeptides, including esPH20 polypeptides and C-terminally truncated PH20 polypeptides provided herein, can be produced by any method known to those of skill in the art including in vivo and in vitro methods. Desired proteins can be expressed in any organism suitable to produce the required amounts and forms of the proteins, such as for example, needed for administration and treatment. Expression hosts include prokaryotic and eukaryotic organisms such as *E. coli*, yeast, plants, insect cells, mammalian cells, including human cell lines and transgenic animals. Expression hosts can differ in their protein production levels as well as the types of post-translational modification that are present on the expressed proteins. The choice of expression host can be made based on these and other factors, such as regulatory and safety considerations, production costs and the need and methods for purification.

Many expression vectors are available and known to those of skill in the art and can be used for expression of proteins. The choice of expression vector will be influenced by the choice of host expression system. In general, expression vectors can include transcriptional promoters and optionally enhancers, translational signals, and transcriptional and translational termination signals. Expression vectors that are used for stable transformation typically have a selectable marker which allows selection and maintenance of the transformed cells. In some cases, an origin of replication can be used to amplify the copy number of the vector.

Soluble hyaluronidase polypeptides, including esPH20, and other C-terminally truncated PH20 polypeptides, also can be utilized or expressed as protein fusions. For example, an enzyme fusion can be generated to add additional functionality to an enzyme. Examples of enzyme fusion proteins include, but are not limited to, fusions of a signal sequence, a tag such as for localization, e.g. a his$_6$ tag or a myc tag, or a tag for purification, for example, a GST fusion, a sequence for directing protein secretion and/or membrane association and other sequences used to increase half-life such as an Fc fusion.

For long-term, high-yield production of recombinant proteins, stable expression is desired. For example, cell lines that stably express a soluble PH20, such as an esPH20, or another C-terminally truncated PH20 polypeptide, can be transformed using expression vectors that contain viral origins of replication or endogenous expression elements and a selectable marker gene. Following the introduction of the vector, cells can be allowed to grow for 1-2 days in an enriched media before they are switched to selective media. The purpose of the selectable marker is to confer resistance to selection, and its presence allows growth and recovery of cells that successfully express the introduced sequences. Resistant cells of stably transformed cells can be proliferated using tissue culture techniques appropriate to the cell types.

Any number of selection systems can be used to recover transformed cell lines. These include, but are not limited to, the herpes simplex virus thymidine kinase (Wigler M et al. (1977) *Cell,* 11:223-32) and adenine phosphoribosyltransferase (Lowy I et al. (1980) *Cell,* 22:817-23) genes, which can be employed in TK– or APRT– cells, respectively. Also, antimetabolite, antibiotic or herbicide resistance can be used as the basis for selection. For example, DHFR, which confers resistance to methotrexate (Wigler M et al. (1980) *Proc. Natl. Acad. Sci,* 77:3567-70); npt, which confers resistance to the aminoglycosides neomycin and G-418 (Colbere-Garapin F et al. (1981) *J. Mol. Biol.,* 150:1-14); and als or pat, which confer resistance to chlorsulfuron and phosphinotricin acetyltransferase, respectively, can be used. Additional selectable genes have been described, for example, trpB, which allows cells to utilize indole in place of typtophan or hisD, which allows cells to utilize histinol in place of histidine (Hartman S C and R C Mulligan (1988) *Proc. Natl. Acad. Sci,* 85:8047-51). Visible markers, such as but not limited to, anthocyanins, beta glucuronidase and its substrate, GUS, and luciferase and its substrate luciferin, also can be used to identify transformants and also to quantify the amount of transient or stable protein expression attributable to a particular vector system (Rhodes C A et al. (1995) *Methods Mol. Biol.* 55:121-131).

The presence and expression of soluble PH20 polypeptides, including esPH20, and other C-terminal truncated PH20 polypeptides, can be monitored. For example, detection of a functional polypeptide can be determined by testing the conditioned media for hyaluronidase enzyme activity under appropriate conditions. Section G below provides exemplary assays to assess the solubility and activity of expressed proteins.

a. Prokaryotic Cells

Prokaryotes, especially *E. coli*, provide a system for producing large amounts of proteins. Transformation of *E. coli* is simple and rapid technique well known to those of skill in the art. Expression vectors for *E. coli* can contain inducible promoters, such promoters are useful for inducing high levels of protein expression and for expressing proteins that exhibit some toxicity to the host cells. Examples of inducible promoters include the lac promoter, the tip promoter, the hybrid tac promoter, the T7 and SP6 RNA promoters and the temperature regulated λPL promoter.

Proteins, such as any provided herein, can be expressed in the cytoplasmic environment of *E. coli*. The cytoplasm is a reducing environment and for some molecules, this can result in the formation of insoluble inclusion bodies. Reducing agents such as dithiothreotol and β-mercaptoethanol and denaturants, such as guanidine-HCl and urea can be used to resolubilize the proteins. An alternative approach is the expression of proteins in the periplasmic space of bacteria which provides an oxidizing environment and chaperonin-like and disulfide isomerases and can lead to the production of soluble protein. Typically, a leader sequence is fused to the protein to be expressed which directs the protein to the periplasm. The leader is then removed by signal peptidases inside the periplasm. Examples of periplasmic-targeting leader sequences include the pelB leader from the pectate lyase gene and the leader derived from the alkaline phosphatase gene. In some cases, periplasmic expression allows leakage of the expressed protein into the culture medium. The secretion of proteins allows quick and simple purification from the culture supernatant. Proteins that are not secreted can be obtained from the periplasm by osmotic lysis. Similar to cytoplasmic expression, in some cases proteins can become insoluble and denaturants and reducing agents can be used to facilitate solubilization and refolding. Temperature of induction and growth also can influence expression levels and solubility, typically temperatures between 25° C. and 37° C. are used. Typically, bacteria produce aglycosylated proteins. Thus, if proteins require glycosylation for function, glycosylation can be added in vitro after purification from host cells.

b. Yeast Cells

Yeasts such as *Saccharomyces cerevisae, Schizosaccharomyces pombe, Yarrowia lipolytica, Kluyveromyces lactis* and *Pichia pastoris* are well known yeast expression hosts that can be used for production of proteins, such as any described herein. Yeast can be transformed with episomal replicating vectors or by stable chromosomal integration by homologous recombination. Typically, inducible promoters are used to regulate gene expression. Examples of such promoters include GAL1, GAL7 and GAL5 and metallothionein promoters, such as CUP1, AOX1 or other *Pichia* or other yeast promoter. Expression vectors often include a selectable marker such as LEU2, TRP1, HIS3 and URA3 for selection and maintenance of the transformed DNA. Proteins expressed in yeast are often soluble. Co-expression with chaperonins such as Bip and protein disulfide isomerase can improve expression levels and solubility. Additionally, proteins expressed in yeast can be directed for secretion using secretion signal peptide fusions such as the yeast mating type alpha-factor secretion signal from *Saccharomyces cerevisae* and fusions with yeast cell surface proteins such as the Aga2p mating adhesion receptor or the *Arxula adeninivorans* glucoamylase. A protease cleavage site such as for the Kex-2 protease, can be engineered to remove the fused sequences from the expressed polypeptides as they exit the secretion pathway. Yeast also is capable of glycosylation at Asn-X-Ser/Thr motifs.

c. Insect Cells

Insect cells, particularly using baculovirus expression, are useful for expressing polypeptides such as hyaluronidase polypeptides. Insect cells express high levels of protein and are capable of most of the post-translational modifications used by higher eukaryotes. Baculovirus have a restrictive host range which improves the safety and reduces regulatory concerns of eukaryotic expression. Typical expression vectors use a promoter for high level expression such as the polyhedrin promoter of baculovirus. Commonly used baculovirus systems include the baculoviruses such as *Autographa californica* nuclear polyhedrosis virus (AcNPV), and the *bombyx mori* nuclear polyhedrosis virus (BmNPV) and an insect cell line such as Sf9 derived from *Spodoptera frugiperda*, *Pseudaletia unipuncta* (A7S) and *Danaus plexippus* (DpN1). For high-level expression, the nucleotide sequence of the molecule to be expressed is fused immediately downstream of the polyhedrin initiation codon of the virus. Mammalian secretion signals are accurately processed in insect cells and can be used to secrete the expressed protein into the culture medium. In addition, the cell lines *Pseudaletia unipuncta* (A7S) and *Danaus plexippus* (DpN1) produce proteins with glycosylation patterns similar to mammalian cell systems. Exemplary insect cells are those that have been altered to reduce immunogenicity, including those with "mammalianized" baculoviruse expression vectors and those lacking the enzyme FT3.

An alternative expression system in insect cells is the use of stably transformed cells. Cell lines such as the Schnieder 2 (S2) and Kc cells (*Drosophila melanogaster*) and C7 cells (*Aedes albopictus*) can be used for expression. The *Drosophila* metallothionein promoter can be used to induce high levels of expression in the presence of heavy metal induction with cadmium or copper. Expression vectors are typically maintained by the use of selectable markers such as neomycin and hygromycin.

d. Mammalian Cells

Mammalian expression systems can be used to express proteins including soluble hyaluronidase polypeptides. Expression constructs can be transferred to mammalian cells by viral infection such as adenovirus or by direct DNA transfer such as liposomes, calcium phosphate, DEAE-dextran and by physical means such as electroporation and microinjection. Expression vectors for mammalian cells typically include an mRNA cap site, a TATA box, a translational initiation sequence (Kozak consensus sequence) and polyadenylation elements. IRES elements also can be added to permit bicistronic expression with another gene, such as a selectable marker. Such vectors often include transcriptional promoter-enhancers for high-level expression, for example the SV40 promoter-enhancer, the human cytomegalovirus (CMV) promoter and the long terminal repeat of Rous sarcoma virus (RSV). These promoter-enhancers are active in many cell types. Tissue and cell-type promoters and enhancer regions also can be used for expression. Exemplary promoter/enhancer regions include, but are not limited to, those from genes such as elastase I, insulin, immunoglobulin, mouse mammary tumor virus, albumin, alpha fetoprotein, alpha 1 antitrypsin, beta globin, myelin basic protein, myosin light chain 2, and gonadotropic releasing hormone gene control. Selectable markers can be used to select for and maintain cells with the expression construct. Examples of selectable marker genes include, but are not limited to, hygromycin B phosphotransferase, adenosine deaminase, xanthine-guanine phosphoribosyl transferase, aminoglycoside phosphotransferase, dihydrofolate reductase (DHFR) and thymidine kinase. For example, expression can be performed in the presence of methotrexate to select for only those cells expressing the DHFR gene. Fusion with cell surface signaling molecules such as TCR-$\zeta$ and Fc$_\epsilon$RI-$\gamma$ can direct expression of the proteins in an active state on the cell surface.

Many cell lines are available for mammalian expression including mouse, rat human, monkey, chicken and hamster cells. Exemplary cell lines include but are not limited to CHO, Balb/3T3, HeLa, MT2, mouse NS0 (nonsecreting) and other myeloma cell lines, hybridoma and heterohybridoma cell lines, lymphocytes, fibroblasts, Sp2/0, COS, NIH3T3, HEK293, 293S, 2B8, and HKB cells. Cell lines also are available adapted to serum-free media which facilitates purification of secreted proteins from the cell culture media. Examples include CHO—S cells (Invitrogen, Carlsbad, Calif., cat #11619-012) and the serum free EBNA-1 cell line (Pham et al., (2003) *Biotechnol. Bioeng.* 84:332-42). Cell lines also are available that are adapted to grow in special mediums optimized for maximal expression. For example, DG44 CHO cells are adapted to grow in suspension culture in a chemically defined, animal product-free medium.

e. Plants

Transgenic plant cells and plants can be used to express proteins such as any described herein. Expression constructs are typically transferred to plants using direct DNA transfer such as microprojectile bombardment and PEG-mediated transfer into protoplasts, and with *agrobacterium*-mediated transformation. Expression vectors can include promoter and enhancer sequences, transcriptional termination elements and translational control elements. Expression vectors and transformation techniques are usually divided between dicot hosts, such as *Arabidopsis* and tobacco, and monocot hosts, such as corn and rice. Examples of plant promoters used for expression include the cauliflower mosaic virus promoter, the nopaline syntase promoter, the ribose bisphosphate carboxylase promoter and the ubiquitin and UBQ3 promoters. Selectable markers such as hygromycin, phosphomannose isomerase and neomycin phosphotransferase are often used to facilitate selection and maintenance of transformed cells. Transformed plant cells can be maintained in culture as cells, aggregates (callus tissue) or regenerated into whole plants. Transgenic plant cells also can include algae engineered to produce hyaluronidase polypeptides. Because plants have different glycosylation patterns than mammalian cells, this can influence the choice of protein produced in these hosts.

3. Purification Techniques

Host cells transformed with a nucleic acid sequence encoding a soluble PH20, including esPH20, and other C-terminal truncated PH20 polypeptides, can be cultured under conditions suitable for the expression and recovery of the encoded protein from cell culture. The protein produced by a recombinant cell is generally secreted, but may be contained intracellularly depending on the sequence and/or the vector used. As will be understood by those of skill in the art, expression vectors containing nucleic acid encoding PH20 can be designed with signal sequences that facilitate direct secretion of PH20 through prokaryotic or eukaryotic cell membrane.

Thus, method for purification of polypeptides from host cells will depend on the chosen host cells and expression systems. For secreted molecules, proteins are generally purified from the culture media after removing the cells. For intracellular expression, cells can be lysed and the proteins purified from the extract. When transgenic organisms such as transgenic plants and animals are used for expression, tissues or organs can be used as starting material to make a lysed cell extract. Additionally, transgenic animal production can include the production of polypeptides in milk or eggs, which can be collected, and if necessary, the proteins can be extracted and further purified using standard methods in the art.

Proteins, such as soluble PH20 polypeptides, including esPH20 polypeptides, or other C-terminal truncated PH20 polypeptides, can be purified using standard protein purification techniques known in the art including but not limited to, SDS-PAGE, size fractionation and size exclusion chromatography, ammonium sulfate precipitation and ionic exchange chromatography, such as anion exchange. Affinity purification techniques also can be utilized to improve the efficiency and purity of the preparations. For example, antibodies, receptors and other molecules that bind PH20 hyaluronidase enzymes can be used in affinity purification. For example, soluble PH20 can be purified from conditioned media.

Expression constructs also can be engineered to add an affinity tag to a protein such as a myc epitope, GST fusion or $His_6$ and affinity purified with myc antibody, glutathione resin and Ni-resin, respectively. Such tags can be joined to the nucleotide sequence encoding a soluble PH20 as described elsewhere herein, which can facilitate purification of soluble proteins. For example, soluble PH20 can be expressed as a recombinant protein with one or more additional polypeptide domains added to facilitate protein purification. Such purification facilitating domains include, but are not limited to, metal chelating peptides such as histidine-tryptophan modules that allow purification on immobilized metals, protein A domains that allow purification on immobilized immunoglobulin and the domain utilized in the FLAGS extension/affinity purification system (Immunex Corp., Seattle Wash.). The inclusion of a cleavable linker sequence such as Factor XA or enterokinase (Invitrogen, San Diego, Calif.) between the purification domain and the expressed PH20 polypeptide is useful to facilitate purification. One such expression vector provides for expression of a fusion protein containing a soluble PH20 and contains nucleic acid encoding 6 histidine residues followed by thioredoxin and an enterokinase cleavage site. The histidine residues facilitate purification on IMIAC (immobilized metal ion affinity chromatography), while the enterokinase cleavage site provides a means for purifying the polypeptide from the fusion protein.

Purity can be assessed by any method known in the art including gel electrophoresis, orthogonal HPLC methods, staining and spectrophotometric techniques. The expressed and purified protein can be analyzed using any assay or method known to one of skill in the art, for example, any described in Section G. These include assays based on the physical and/or functional properties of the protein, including, but not limited to, analysis by gel electrophoresis, immunoassay and assays of hyaluronidase activity.

Depending on the expression system and host cells used, the resulting polypeptide can be heterogeneous due to peptidases present in the culture medium upon production and purification. For example, culture of soluble PH20 in CHO cells can result in a mixture of heterogeneous polypeptides. An exemplary protocol for the generation, production and purification of a soluble PH20 (e.g. rHuPH20) is described in Examples 13-15 below. Similarly, for example, expression of a nucleic acid encoding a polypeptide having a sequence of amino acids 36-497 set forth in SEQ ID NO:60, can result in a heterogeneous mixture of polypeptides variably including polypeptides that end at 497, 496, 495, 494, 493, 492, 491, 490, 489 or shorter.

F. Preparation, Formulation and Administration of Extended Soluble PH20 Polypeptides, and Other Soluble PH20 Polypeptides Pharmaceutical compositions of soluble PH20 polypeptides, including esPH20, are provided herein for administration. The soluble PH20 polypeptides can be formulated separately, or can be co-formulated or co-administered with pharmaceutical formulations of other therapeutic agents, for example, as described in Section G. The compounds can be formulated into suitable pharmaceutical preparations such as solutions, suspensions, tablets, dispersible tablets, pills, capsules, powders, sustained release formulations or elixirs, for oral administration, as well as transdermal patch preparation and dry powder inhalers. Typically, the compounds are formulated into pharmaceutical compositions using techniques and procedures well known in the art (see e.g., Ansel *Introduction to Pharmaceutical Dosage Forms*, Fourth Edition, 1985, 126).

Typically, a therapeutically effective dosage is contemplated. The amount of a selected soluble PH20 to be administered for the treatment of a disease or condition can be determined by standard clinical techniques. In addition, in vitro assays and animal models can be employed to help identify optimal dosage ranges. The precise dosage, which can be determined empirically, can depend on the particular enzyme, the route of administration, the type of disease to be treated and the seriousness of the disease.

Hence, it is understood that the precise dosage and duration of treatment is a function of the disease being treated and can be determined empirically using known testing protocols or by extrapolation from in vivo or in vitro test data. It is to be noted that concentrations and dosage values also can vary with the severity of the condition to be alleviated. It is to be further understood that for any particular subject, specific dosage regimens should be adjusted over time according to the individual need and the professional judgment of the person administering or supervising the administration of the compositions, and that the concentration ranges set forth herein are exemplary only and are not intended to limit the scope or use of compositions and combinations containing them. The compositions can be administered hourly, daily, weekly, monthly, yearly or once. Generally, dosage regimens are chosen to limit toxicity. It should be noted that the attending physician would know how to and when to terminate, interrupt or adjust therapy to lower dosage due to toxicity, or bone marrow, liver or kidney or other tissue dysfunctions. Conversely, the attending physician would also know how to and when to adjust treatment to higher levels if the clinical response is not adequate (precluding toxic side effects).

Pharmaceutically acceptable compositions are prepared in view of approvals for a regulatory agency or other agency prepared in accordance with generally recognized pharmacopeia for use in animals and in humans. Compositions can take the form of solutions, suspensions, emulsion, tablets, pills, capsules, powders, and sustained release formulations. A composition can be formulated as a suppository, with traditional binders and carriers such as triglycerides. Oral formulation can include standard carriers such as pharmaceutical grades of mannitol, lactose, starch, magnesium stearate, sodium saccharine, cellulose, magnesium carbonate, and other such agents. The formulation should suit the mode of administration.

Pharmaceutical compositions can include carriers such as a diluent, adjuvant, excipient, or vehicle with which an soluble PH20 is administered. Examples of suitable pharmaceutical carriers are described in "Remington's Pharmaceutical Sciences" by E. W. Martin. Such compositions will contain a therapeutically effective amount of the compound, generally in purified form, together with a suitable amount of carrier so as to provide the form for proper administration to the patient. Such pharmaceutical carriers can be sterile liquids, such as water and oils, including those of petroleum, animal, vegetable or synthetic origin, such as peanut oil, soybean oil, mineral oil, and sesame oil. Water is a typical carrier when the pharmaceutical composition is administered intravenously. Saline solutions and aqueous dextrose and glycerol solutions also can be employed as liquid carriers, particularly for injectable solutions. Compositions can contain along with an active ingredient: a diluent such as lactose, sucrose, dicalcium phosphate, or carboxymethylcellulose; a lubricant, such as magnesium stearate, calcium stearate and talc; and a binder such as starch, natural gums, such as gum acacia, gelatin, glucose, molasses, polyvinylpyrrolidine, celluloses and derivatives thereof, povidone, crospovidones and other such binders known to those of skill in the art. Suitable pharmaceutical excipients include starch, glucose, lactose, sucrose, gelatin, malt, rice, flour, chalk, silica gel, sodium stearate, glycerol monostearate, talc, sodium chloride, dried skim milk, glycerol, propylene, glycol, water, and ethanol. A composition, if desired, also can contain minor amounts of wetting or emulsifying agents, or pH buffering agents, for example, acetate, sodium citrate, cyclodextrine derivatives, sorbitan monolaurate, triethanolamine sodium acetate, triethanolamine oleate, and other such agents.

Formulations of pharmaceutically therapeutically active compounds and derivatives thereof are provided for administration to humans and animals in unit dosage forms or multiple dosage forms. For example compounds can be formulated as tablets, capsules, pills, powders, granules, sterile parenteral solutions or suspensions, and oral solutions or suspensions, and oil water emulsions containing suitable quantities of the compounds or pharmaceutically acceptable derivatives thereof. Each unit dose contains a predetermined quantity of therapeutically active compound sufficient to produce the desired therapeutic effect, in association with the required pharmaceutical carrier, vehicle or diluent. Examples of unit dose forms include ampoules and syringes and individually packaged tablets or capsules. Unit dose forms can be administered in fractions or multiples thereof. A multiple dose form is a plurality of identical unit dosage forms packaged in a single container to be administered in segregated unit dose form. Examples of multiple dose forms include vials, bottles of tablets or capsules or bottles of pints or gallons. Hence, multiple dose form is a multiple of unit doses that are not segregated in packaging. Generally, dosage forms or compositions containing active ingredient in the range of 0.005% to 100% with the balance made up from non-toxic carrier can be prepared.

Compositions provided herein typically are formulated for administration by subcutaneous route, although other routes of administration are contemplated, such as any route known to those of skill in the art including intramuscular, intraperitoneal, intravenous, intradermal, intralesional, intraperitoneal injection, epidural, vaginal, rectal, local, otic, transdermal administration or any route. Formulations suited for such routes are known to one of skill in the art. Administration can be local, topical or systemic depending upon the locus of treatment. Local administration to an area in need of treatment can be achieved by, for example, but not limited to, local infusion during surgery, topical application, e.g., in conjunction with a wound dressing after surgery, by injection, by means of a catheter, by means of a suppository, or by means of an implant. Compositions also can be administered with other biologically active agents, either sequentially, intermittently or in the same composition.

The most suitable route in any given case depends on a variety of factors, such as the nature of the disease, the tolerance of the subject to a particular administration route, the severity of the disease, and the particular composition that is used. Typically, the compositions provided herein are administered parenterally. In some examples, soluble PH20 compositions are administered so that they reach the interstitium of skin or tissues, thereby degrading the interstitial space for subsequent delivery of a therapeutic agent. Thus, in some examples, direct administration under the skin, such as by subcutaneous administration methods, is contemplated. Thus, in one example, local administration can be achieved by injection, such as from a syringe or other article of manufacture containing a injection device such as a needle. In another example, local administration can be achieved by infusion, which can be facilitated by the use of a pump or other similar device. Other modes of administration also are contemplated. Pharmaceutical compositions can be formulated in dosage forms appropriate for each route of administration.

Administration methods can be employed to decrease the exposure of selected soluble PH20 polypeptides to degradative processes, such as proteolytic degradation and immunological intervention via antigenic and immunogenic responses. Examples of such methods include local administration at the site of treatment. Pegylation of therapeutics has been reported to increase resistance to proteolysis, increase plasma half-life, and decrease antigenicity and immunogenicity. Examples of pegylation methodologies are known in the art (see for example, Lu and Felix, *Int. J. Peptide Protein Res.*, 43: 127-138, 1994; Lu and Felix, *Peptide Res.*, 6: 142-6, 1993; Felix et al., *Int. J. Peptide Res.*, 46: 253-64, 1995; Benhar et al., *J. Biol. Chem.*, 269: 13398-404, 1994; Brumeanu et al., *J Immunol.*, 154:3088-95, 1995; see also, Caliceti et al. (2003) *Adv. Drug Deliv. Rev.* 55(10):1261-77 and Molineux (2003) *Pharmacotherapy* 23 (8 Pt 2):3S-8S). Pegylation also can be used in the delivery of nucleic acid molecules in vivo. For example, pegylation of adenovirus can increase stability and gene transfer (see, e.g., Cheng et al. (2003) *Pharm. Res.* 20(9): 1444-51).

1. Injectables, Solutions and Emulsions

Parenteral administration, generally characterized by injection or infusion, either subcutaneously, intramuscularly, intravenous or intradermally is contemplated herein. Injectables can be prepared in conventional forms, either as liquid solutions or suspensions, solid forms suitable for solution or suspension in liquid prior to injection, or as emulsions.

Suitable excipients are, for example, water, saline, dextrose, glycerol or ethanol. The pharmaceutical compositions may contain other minor amounts of non-toxic auxiliary substances such as wetting or emulsifying agents, pH buffering agents, stabilizers, solubility enhancers, and other such agents, such as for example, sodium acetate, sodium phosphate, sorbitan monolaurate, triethanolamine oleate and cyclodextrins. Implantation of a slow-release or sustained-release system, such that a constant level of dosage is maintained (see, e.g., U.S. Pat. No. 3,710,795) is also contemplated herein. The percentage of active compound contained in such parenteral compositions is highly dependent on the specific nature thereof, as well as the activity of the compound and the needs of the subject.

Injectables are designed for local and systemic administration. For purposes herein, local administration is desired for direct administration to the affected interstitium. Preparations for parenteral administration include sterile solutions ready for injection, sterile dry soluble products, such as lyophilized powders, ready to be combined with a solvent just prior to use, including hypodermic tablets, sterile suspensions ready for injection, sterile dry insoluble products ready to be combined with a vehicle just prior to use and sterile emulsions. The solutions may be either aqueous or nonaqueous. If administered intravenously, suitable carriers include physiological saline or phosphate buffered saline (PBS), and solutions containing thickening and solubilizing agents, such as glucose, polyethylene glycol, and polypropylene glycol and mixtures thereof.

Pharmaceutically acceptable carriers used in parenteral preparations include aqueous vehicles, nonaqueous vehicles, antimicrobial agents, isotonic agents, buffers, antioxidants, local anesthetics, suspending and dispersing agents, emulsifying agents, sequestering or chelating agents and other pharmaceutically acceptable substances. Examples of aqueous vehicles include Sodium Chloride Injection, Ringers Injection, Isotonic Dextrose Injection, Sterile Water Injection, Dextrose and Lactated Ringers Injection. Nonaqueous parenteral vehicles include fixed oils of vegetable origin, cottonseed oil, corn oil, sesame oil and peanut oil. Antimicrobial agents in bacteriostatic or fungistatic concentrations can be added to parenteral preparations packaged in multiple-dose containers, which include phenols or cresols, mercurials, benzyl alcohol, chlorobutanol, methyl and propyl p-hydroxybenzoic acid esters, thimerosal, benzalkonium chloride and benzethonium chloride. Isotonic agents include sodium chloride and dextrose. Buffers include phosphate and citrate. Antioxidants include sodium bisulfate. Local anesthetics include procaine hydrochloride. Suspending and dispersing agents include sodium carboxymethylcellulose, hydroxypropyl methylcellulose and polyvinylpyrrolidone. Emulsifying agents include Polysorbate 80 (TWEEN 80). A sequestering or chelating agent of metal ions include EDTA. Pharmaceutical carriers also include ethyl alcohol, polyethylene glycol and propylene glycol for water miscible vehicles and sodium hydroxide, hydrochloric acid, citric acid or lactic acid for pH adjustment.

The concentration of the pharmaceutically active compound is adjusted so that an injection or infusion provides an effective amount to produce the desired pharmacological effect, such as glycemic control. The exact dose depends on the age, weight and condition of the patient or animal as is known in the art. The unit-dose parenteral preparations can be packaged in, for example, an ampoule, a cartridge, a vial or a syringe with a needle. The volume of liquid solution or reconstituted powder preparation, containing the pharmaceutically active compound, is a function of the disease to be treated and the particular article of manufacture chosen for package. All preparations for parenteral administration must be sterile, as is known and practiced in the art.

In one example, pharmaceutical preparation can be in liquid form, for example, solutions, syrups or suspensions. If provided in liquid form, the pharmaceutical preparations can be provided as a concentrated preparation to be diluted to a therapeutically effective concentration before use. Such liquid preparations can be prepared by conventional means with pharmaceutically acceptable additives such as suspending agents (e.g., sorbitol syrup, cellulose derivatives or hydrogenated edible fats); emulsifying agents (e.g., lecithin or acacia); non-aqueous vehicles (e.g., almond oil, oily esters, or fractionated vegetable oils); and preservatives (e.g., methyl or propyl-p-hydroxybenzoates or sorbic acid). In another example, pharmaceutical preparations can be presented in lyophilized form for reconstitution with water or other suitable vehicle before use.

Lyophilized Powders

Of interest herein are lyophilized powders, which can be reconstituted for administration as solutions, emulsions and other mixtures. They may also be reconstituted and formulated as solids or gels.

The sterile, lyophilized powder is prepared by dissolving a compound of inactive enzyme in a buffer solution. The buffer solution may contain an excipient which improves the stability or other pharmacological component of the powder or reconstituted solution, prepared from the powder. Subsequent sterile filtration of the solution followed by lyophilization under standard conditions known to those of skill in the art provides the desired formulation. Briefly, the lyophilized powder is prepared by dissolving an excipient, such as dextrose, sorbital, fructose, corn syrup, xylitol, glycerin, glucose, sucrose or other suitable agent, in a suitable buffer, such as citrate, sodium or potassium phosphate or other such buffer known to those of skill in the art. Then, a selected enzyme is added to the resulting mixture, and stirred until it dissolves. The resulting mixture is sterile filtered or treated to remove particulates and to insure sterility, and apportioned into vials for lyophilization. Each vial will contain a single dosage or multiple dosages of the compound. The lyophilized powder can be stored under appropriate conditions, such as at about 4° C. to room temperature. Reconstitution of this lyophilized powder with an appropriate buffer solution provides a formulation for use in parenteral administration.

2. Topical Administration

Topical mixtures are prepared as described for the local and systemic administration. The resulting mixture can be a solution, suspension, emulsions or the like and are formulated as creams, gels, ointments, emulsions, solutions, elixirs, lotions, suspensions, tinctures, pastes, foams, aerosols, irrigations, sprays, suppositories, bandages, dermal patches or any other formulations suitable for topical administration.

The compounds or pharmaceutically acceptable derivatives thereof may be formulated as aerosols for topical application, such as by inhalation (see, e.g., U.S. Pat. Nos. 4,044, 126, 4,414,209, and 4,364,923, which describe aerosols for delivery of a steroid useful for treatment inflammatory diseases, particularly asthma). These formulations for administration to the respiratory tract can be in the form of an aerosol or solution for a nebulizer, or as a microfine powder for insufflation, alone or in combination with an inert carrier such as lactose. In such a case, the particles of the formulation will typically have diameters of less than 50 microns, or less than 10 microns.

The compounds can be formulated for local or topical application, such as for topical application to the skin and mucous membranes, such as in the eye, in the form of gels, creams, and lotions and for application to the eye or for intracisternal or intraspinal application. Topical administration is contemplated for transdermal delivery and also for administration to the eyes or mucosa, or for inhalation therapies. Nasal solutions of the active compound alone or in combination with other pharmaceutically acceptable excipients also can be administered.

Formulations suitable for transdermal administration are provided. They can be provided in any suitable format, such as discrete patches adapted to remain in intimate contact with the epidermis of the recipient for a prolonged period of time. Such patches contain the active compound in optionally buffered aqueous solution of, for example, 0.1 to 0.2 M concentration with respect to the active compound. Formulations suitable for transdermal administration also can be delivered by iontophoresis (see, e.g., *Pharmaceutical Research* 3 (6): 318 (1986)) and typically take the form of an optionally buffered aqueous solution of the active compound.

3. Compositions for Other Routes of Administration

Depending upon the condition treated other routes of administration, such as topical application, transdermal patches, oral and rectal administration are also contemplated herein. For example, pharmaceutical dosage forms for rectal administration are rectal suppositories, capsules and tablets for systemic effect. Rectal suppositories include solid bodies for insertion into the rectum which melt or soften at body temperature releasing one or more pharmacologically or therapeutically active ingredients. Pharmaceutically acceptable substances utilized in rectal suppositories are bases or vehicles and agents to raise the melting point. Examples of bases include cocoa butter (theobroma oil), glycerin-gelatin, carbowax (polyoxyethylene glycol) and appropriate mixtures of mono-, di- and triglycerides of fatty acids. Combinations of the various bases may be used. Agents to raise the melting point of suppositories include spermaceti and wax. Rectal suppositories may be prepared either by the compressed method or by molding. The typical weight of a rectal suppository is about 2 to 3 gm. Tablets and capsules for rectal administration are manufactured using the same pharmaceutically acceptable substance and by the same methods as for formulations for oral administration.

Formulations suitable for rectal administration can be provided as unit dose suppositories. These can be prepared by admixing the active compound with one or more conventional solid carriers, for example, cocoa butter, and then shaping the resulting mixture.

For oral administration, pharmaceutical compositions can take the form of, for example, tablets or capsules prepared by conventional means with pharmaceutically acceptable excipients such as binding agents (e.g., pregelatinized maize starch, polyvinyl pyrrolidone or hydroxypropyl methylcellulose); fillers (e.g., lactose, microcrystalline cellulose or calcium hydrogen phosphate); lubricants (e.g., magnesium stearate, talc or silica); disintegrants (e.g., potato starch or sodium starch glycolate); or wetting agents (e.g., sodium lauryl sulphate). The tablets can be coated by methods well-known in the art.

Formulations suitable for buccal (sublingual) administration include, for example, lozenges containing the active compound in a flavored base, usually sucrose and acacia or tragacanth; and pastilles containing the compound in an inert base such as gelatin and glycerin or sucrose and acacia.

Pharmaceutical compositions also can be administered by controlled release formulations and/or delivery devices (see, e.g., in U.S. Pat. Nos. 3,536,809; 3,598,123; 3,630,200; 3,845,770; 3,847,770; 3,916,899; 4,008,719; 4,687,610; 4,769,027; 5,059,595; 5,073,543; 5,120,548; 5,354,566; 5,591,767; 5,639,476; 5,674,533 and 5,733,566).

Various delivery systems are known and can be used to administer selected soluble PH20 polypeptides, such as but not limited to, encapsulation in liposomes, microparticles, microcapsules, recombinant cells capable of expressing the compound, receptor mediated endocytosis, and delivery of nucleic acid molecules encoding selected soluble PH20 polypeptides such as retrovirus delivery systems.

Hence, in certain embodiments, liposomes and/or nanoparticles also can be employed with administration of soluble PH20 polypeptides. Liposomes are formed from phospholipids that are dispersed in an aqueous medium and spontaneously form multilamellar concentric bilayer vesicles (also termed multilamellar vesicles (MLVs)). MLVs generally have diameters of from 25 nm to 4 µm. Sonication of MLVs results in the formation of small unilamellar vesicles (SUVs) with diameters in the range of 200 to 500 angstroms containing an aqueous solution in the core.

Phospholipids can form a variety of structures other than liposomes when dispersed in water, depending on the molar ratio of lipid to water. At low ratios, the liposomes form. Physical characteristics of liposomes depend on pH, ionic strength and the presence of divalent cations. Liposomes can show low permeability to ionic and polar substances, but at elevated temperatures undergo a phase transition which markedly alters their permeability. The phase transition involves a change from a closely packed, ordered structure, known as the gel state, to a loosely packed, less-ordered structure, known as the fluid state. This occurs at a characteristic phase-transition temperature and results in an increase in permeability to ions, sugars and drugs.

Liposomes interact with cells via different mechanisms: endocytosis by phagocytic cells of the reticuloendothelial system such as macrophages and neutrophils; adsorption to the cell surface, either by nonspecific weak hydrophobic or electrostatic forces, or by specific interactions with cell-surface components; fusion with the plasma cell membrane by insertion of the lipid bilayer of the liposome into the plasma membrane, with simultaneous release of liposomal contents into the cytoplasm; and by transfer of liposomal lipids to cellular or subcellular membranes, or vice versa, without any association of the liposome contents. Varying the liposome formulation can alter which mechanism is operative, although more than one can operate at the same time. Nanocapsules can generally entrap compounds in a stable and reproducible way. To avoid side effects due to intracellular polymeric overloading, such ultrafine particles (sized around 0.1 µm) should be designed using polymers able to be degraded in vivo. Biodegradable polyalkyl-cyanoacrylate nanoparticles that meet these requirements are contemplated for use herein, and such particles can be easily made.

4. Dosage and Administration

The soluble PH20 polypeptides, including esPH20, provided herein can be formulated as pharmaceutical compositions for single dosage or multiple dosage administration. The selected hyaluronan degrading enzyme is included in an amount sufficient to exert a therapeutically useful effect in the absence of undesirable side effects on the patient treated. The therapeutically effective concentration can be determined empirically by testing the polypeptides in known in vitro and in vivo systems such as by using the assays provided herein or known in the art (see e.g., Taliani et al. (1996) *Anal. Biochem.*, 240: 60-67; Filocamo et al. (1997) *J Virology*, 71: 1417-1427; Sudo et al. (1996) *Antiviral Res*. 32: 9-18; Buffard et al. (1995) *Virology*, 209:52-59; Bianchi et al. (1996) *Anal. Biochem.*, 237: 239-244; Hamatake et al. (1996) *Intervirology*

39:249-258; Steinkuhler et al. (1998) *Biochem.*, 37:8899-8905; D'Souza et al. (1995) *J. Gen. Virol.*, 76:1729-1736; Takeshita et al. (1997) *Anal. Biochem.*, 247:242-246; see also e.g., Shimizu et al. (1994) *J. Virol.* 68:8406-8408; Mizutani et al. (1996) *J. Virol.* 70:7219-7223; Mizutani et al. (1996) *Biochem. Biophys. Res. Commun.*, 227:822-826; Lu et al. (1996) *Proc. Natl. Acad. Sci.* (*USA*), 93:1412-1417; Hahm et al., (1996) *Virology*, 226:318-326; Ito et al. (1996) *J. Gen. Virol.*, 77:1043-1054; Mizutani et al. (1995) *Biochem. Biophys. Res. Commun.*, 212:906-911; Cho et al. (1997) *J. Virol. Meth.* 65:201-207 and then extrapolated therefrom for dosages for humans.

Typically, a therapeutically effective dose of a soluble PH20 enzyme is at or about 10 Unit (U) to 500,000 Units, 100 Units to 100,000 Units, 500 Units to 50,000 Units, 1000 Units to 10,000 Units, 5000 Units to 7500 Units, 5000 Units to 50,000 Units, or 1,000 Units to 10,000 Units, generally 1,000 to 50,000 Units, in a stabilized solution or suspension or a lyophilized from. The formulations can be provided in unit-dose forms such as, but not limited to, ampoules, syringes and individually packaged tablets or capsules. The dispersing agent can be administered alone, or with other pharmacologically effective agent or therapeutic agent in a total volume of 0.1-100 ml, 1-50 ml, 10-50 ml, 10-30 ml, 1-20 ml, or 1-10 ml, typically 10-50 ml.

For example, a soluble PH20, including esPH20, can be administered subcutaneously at or about 10 U, 20 U, 30 U, 40 U, 50 U, 100 U, 150 U, 200 U, 250 U, 300 U, 350 U, 400 U, 450 U, 500 U, 600 U, 700 U, 800 U, 900 U, 1000 U, 2,000 U, 3,000 U, 4,000 Units, 5,000 U or more. In some examples, dosages can be provided as a ratio of amount of a soluble PH20 to therapeutic agent administered. For example, a soluble PH20 polypeptide can be administered at 1 hyaluronidase U/therapeutic agent U (1:1) to 50:1 or more, for example, at or about 1:1, 2:1, 3:1, 4:1, 5:1, 6:1, 7:1, 8:1, 9:1, 10:1, 11:1, 12:1, 13:1, 14:1, 15:1, 20:1, 25:1, 30:1, 35:1, 40:1, 45:1, 50:1 or more. Typically, volumes of injections or infusions of a soluble PH20 contemplated herein are from at or about 0.01 mL, 0.05 mL, 0.1 mL, 0.2 mL, 0.3 mL, 0.4 mL, 0.5 mL, 1 mL, 2 mL, 3 mL, 4 mL, 5 mL, 6 mL, 7 mL, 8 mL, 9 ml, 10 ml, 20 ml, 30 ml, 40 ml, 50 ml or more. The soluble PH20 can be provided as a stock solution at or about 100 U/ml, 150 U/ml, 200 U/ml, 300 U/ml, 400 U/ml, 500 U/mL, 600 U/mL, 800 U/mL or 1000 U/mL, or can be provided in a more concentrated form, for example at or about 2000 U/ml, 3000 Units/ml, 4000 U/ml, 5000 U/ml, 8000 U/ml, 10,000 U/mL or 20,000 U/mL for use directly or for dilution to the effective concentration prior to use. The soluble PH20 can be provided as a liquid or lyophilized formulation.

5. Packaging, Articles of Manufacture and Kits

Pharmaceutical compounds of soluble PH20 polypeptides, including esPH20, or nucleic acids encoding such polypeptides, or a derivative or variant thereof can be packaged as articles of manufacture containing packaging material, a pharmaceutical composition which is effective for treating a disease or disorder, and a label that indicates that the soluble PH20 or nucleic acid molecule is to be used for treating the disease or disorder. Combinations of a selected soluble PH20 hyaluronidase, or derivative or variant thereof and an therapeutic agent also can be packaged in an article of manufacture.

The articles of manufacture provided herein contain packaging materials. Packaging materials for use in packaging pharmaceutical products are well known to those of skill in the art. See, for example, U.S. Pat. Nos. 5,323,907, 5,052,558 and 5,033,252, each of which is incorporated herein in its entirety. Examples of pharmaceutical packaging materials include, but are not limited to, blister packs, bottles, tubes, inhalers, pumps, bags, vials, containers, syringes, bottles, and any packaging material suitable for a selected formulation and intended mode of administration and treatment. The articles of manufacture can include a needle or other injection device so as to facilitate administration (e.g. sub-epidermal administration) for local injection purposes. A wide array of formulations of the compounds and compositions provided herein are contemplated including a soluble PH20, such as an esPH20, and a therapeutic agent known to treat a particular disease or disorder. The choice of package depends on the soluble PH20 and/or therapeutic agent, and whether such compositions will be packaged together or separately. In one example, the soluble PH20 can be packaged as a mixture with the therapeutic agent. In another example, the components can be packaged as separate compositions Selected soluble PH20 polypeptides, such as esPH20 polypeptides, therapeutic agents and/or articles of manufacture thereof also can be provided as kits. Kits can include a pharmaceutical composition described herein and an item for administration provided as an article of manufacture. For example a soluble PH20 polypeptide can be supplied with a device for administration, such as a syringe, an inhaler, a dosage cup, a dropper, or an applicator. The compositions can be contained in the item for administration or can be provided separately to be added later. The kit can, optionally, include instructions for application including dosages, dosing regimens and instructions for modes of administration. Kits also can include a pharmaceutical composition described herein and an item for diagnosis. For example, such kits can include an item for measuring the concentration, amount or activity of the selected protease in a subject.

G. Assays

Soluble PH20 polypeptides provided herein, including esPH20 polypeptides, are soluble and retain a hyaluronidase enzymatic activity. N-glycosylated or N-partially glycosylated PH20 polypeptides provided herein retain a hyaluronidase enzymatic activity. The activity of a PH20 provided herein is or is about 30%, 40%, 50%, 60%, 70%, 80%, 90%, 91%, 92%, 93%, 94%, 95%, 96%, 97%, 98%, 99% or more compared to the activity of a corresponding PH20 that is not C-terminally truncated or N-partially glycosylated. The activity of a soluble PH20 hyaluronidase polypeptide, such as an esPH20, can be assessed using methods well known in the art. These methods include, for example, a microturbidity assay and a microtiter assay using biotinylated hyaluronic acid. Activity and assessments can be performed on conditioned medium or supernatants or on purified protein. The solubility of a protein also can be determined, for example, by a Triton® X-114 partition assay. In all assays, the activity or solubility of a soluble PH20 can be compared to a control, for example, a full length PH20 lacking C-terminal truncations.

1. Hyaluronidase Activity

The activity of a soluble PH20 polypeptide can be assessed using methods well known in the art. For example, the USP XXII assay for hyaluronidase determines activity indirectly by measuring the amount of undegraded hyaluronic acid, or hyaluronan, (HA) substrate remaining after the enzyme is allowed to react with the HA for 30 min at 37° C. (USP XXII-NF XVII (1990) 644-645 United States Pharmacopeia Convention, Inc, Rockville, Md.). A Hyaluronidase Reference Standard (USP) or National Formulary (NF) Standard Hyaluronidase solution can be used in an assay to ascertain the activity, in units, of any hyaluronidase.

In one example, activity is measured using a microturbidity assay, as described in Example 12. This is based on the formation of an insoluble precipitate when hyaluronic acid binds with serum albumin. The activity is measured by incubating hyaluronidase with sodium hyaluronate (hyaluronic acid) for a set period of time (e.g. 10 minutes) and then precipitating the undigested sodium hyaluronate with the addition of acidified serum albumin. The turbidity of the resulting sample is measured at 640 nm after an additional development period. The decrease in turbidity resulting from hyaluronidase activity on the sodium hyaluronate substrate is a measure of hyaluronidase enzymatic activity.

In another example, hyaluronidase activity is measured using a microtiter assay in which residual biotinylated hyaluronic acid is measured following incubation with hyaluronidase (see e.g. Frost and Stern (1997) *Anal. Biochem.* 251:263-269, U.S. Patent Publication No. 20050260186). In Example 4, the hyaluronidase activity of truncated human PH20 hyaluronidase is determined using biotinylated hyaluronic acid. The free carboxyl groups on the glucuronic acid residues of hyaluronic acid are biotinylated, and the biotinylated hyaluronic acid substrate is covalently coupled to a microtiter plate. Following incubation with hyaluronidase, the residual biotinylated hyaluronic acid substrate is detected using an avidin-peroxidase reaction, and compared to that obtained following reaction with hyaluronidase standards of known activity. As the substrate is covalently bound to the microtiter plate, artifacts such as pH-dependent displacement of the biotinylated substrate does not occur. The sensitivity permits rapid measurement of hyaluronidase activity from cultured cells and biological samples with an inter-assay variation of less than 10%.

Other assays to measure hyaluronidase activity also are known in the art and can be used in the methods herein (see e.g. Delpech et al., (1995) *Anal. Biochem.* 229:35-41; Takahashi et al., (2003) *Anal. Biochem.* 322:257-263).

Many hyaluronidase assays have been based upon the measurement of the generation of new reducing N-acetylamino groups (Bonner and Cantey, *Clin. Chim. Acta* 13:746-752, 1966), or loss of viscosity (De Salegui et al., *Arch. Biochem. Biophys.* 121:548-554, 1967) or turbidity (Dorfman and Ott, *J. Biol. Chem.* 172:367, 1948). With purified substrates all of these methods suffice for determination of the presence or absence of endoglucosamidic activity.

Substantially purified glycosaminoglycan substrates can also be used in a Gel Shift Assay. Glycosaminoglycans are mixed with recombinant PH20, such as a soluble PH20, to test for endoglucosidic activity that results in a shift in substrate mobility within the gel. Exemplary of such substrates include, but are not limited to, chondroitin-4 and 6 sulfate, dermatan sulfate, heparan-sulfate, which can be obtained from Sigma Chemical. Human umbilical cord Hyaluronan can be obtained from ICN. For example, each test substrate can be diluted to at or about 0.1 mg/ml in a buffer range from pH 3.5-7.5. In such an exemplary assay, at or about 10 µl samples of purified soluble PH20 or conditioned media from PH20 expressing cells can be mixed with at or about 90 µl of test substrate in desired buffer and incubated for 3 hours at 37° C. Following incubation, samples are neutralized with sample buffer (Tris EDTA pH 8.0, Bromophenol Blue and glycerol) followed by electrophoresis. Glycosaminoglycans can be detected using any method known in the art, for example, glycosaminoglycans can be detected by staining the gels using 0.5% Alcian Blue in 3% Glacial Acetic Acid overnight followed by destaining in 7% Glacial Acetic Acid. Degradation is determined by comparison of substrate mobility in the presence and absence of enzyme.

Hyaluronidase activity can also be detected by substrate gel zymography (Guentenhoner et al., 1992, *Matrix* 388-396). In this assay a sample is applied to a SDS-PAGE gel containing hyaluronic acid and the proteins in the sample separated by electrophoresis. The gel is then incubated in an enzyme assay buffer and subsequently stained to detect the hyaluronic acid in the gel. Hyaluronidase activity is visualized as a cleared zone in the substrate gel.

The ability of a soluble PH20 polypeptide to act as a spreading or diffusing agent also can be assessed. For example, trypan blue dye can be injected subcutaneously with or without a soluble PH20 into the lateral skin on each side of nude mice. The dye area is then measured, such as with a microcaliper, to determine the ability of the hyaluronan degrading enzyme to act as a spreading agent (U.S. Patent No. 20060104968). The effect of co-administration of hyaluronidase with another agent, for example a therapeutic agent, on the pharmacokinetic and pharmacodynamic properties of that agent also can be assessed in vivo using animal model and/or human subjects, such as in the setting of a clinical trial.

The functional activity of a soluble PH20, such as esPH20 can be compared and/or normalized to a reference standard using any of these assays. This can be done to determine what a functionally equivalent amount of a soluble PH20 is. For example, the ability of a soluble PH20 to act as a spreading or diffusing agent can be assessed by injecting it into the lateral skin of mice with trypan blue, and the amount required to achieve the same amount of diffusion as, for example, 100 units of a Hyaluronidase Reference Standard, can be determined. The amount of soluble PH20 required is, therefore, functionally equivalent to 100 hyaluronidase units.

2. Solubility

Solubility of a hyaluronidase can be determined by any method known to one of the skill in the art. One method for determining solubility is by detergent partitioning. For example, a soluble PH20 polypeptide can be distinguished, for example, by its partitioning into the aqueous phase of a Triton® X-114 solution at 37° C. (Bordier et al., (1981) *J. Biol. Chem.,* 256:1604-1607). For example, the solubility of the PH20 polypeptides described herein is assessed as described in Example 4. Membrane-anchored hyaluronidases, such as lipid-anchored hyaluronidases, including GPI-anchored hyaluronidases, will partition into the detergent-rich phase, but will partition into the detergent-poor or aqueous phase following treatment with Phospholipase C. Phospholipase C is an enzyme that cleaves the phosphoglycerol bond found in GPI-anchored proteins. Treatment with PLC will cause release of GPI-linked proteins from the outer cell membrane.

Another method for assessing solubility is to determine whether a PH20 polypeptide is GPI-anchored. A GPI-anchored PH20 polypeptide is bound to the cell membrane and therefore insoluble. To determine whether a PH20 polypeptide is GPI-anchored, one can assess solubility before and after PLC/PLD hydrolysis, and also use predictive algorithms to identify a GPI-anchor attachment signal sequence. GPI-anchored proteins can be identified by their solubilization after specific enzymatic or chemical cleavage, in conjunction with detergent partitioning (e.g., in Triton® X-114), antibody recognition, and metabolic radioactive labeling.

A common method used to demonstrate that a protein has a GPI anchor is its release from the cell surface or its solubilization by treating with bacterial PI-PLC or trypanosome-derived GPI-specific phospholipase C (GPI-PLC). These enzymes cleave a diacylglycerol in the membrane and produce the immunoreactive glycan epitope (CRD) on the protein, which can be detected by Western blotting with antibodies produced against the GPI of trypanosomes. One common problem with this approach especially encountered in mammalian cells is that the lipases cannot cleave a GPI anchor in which the inositol is acylated. These require prior treatment with mild alkali to remove the fatty acid on the inositol ring. Alternatively, serum-derived GPI-specific phospholipase D can be used to cleave GPI anchors. This enzyme cleaves between the inositol ring and the phosphatidic acid moiety and is not inhibited by inositol acylation. Hydrofluoric acid cleaves GPI anchors between the inositol ring and phosphatidic acid and also cleaves the phosphodiester linkages between any phosphoethanolamines and mannosyl residues. Dilute nitrous acid is particularly useful in the study of GPI anchors because it cleaves specifically between the nonacetylated glucosamine and the inositol ring, releasing the protein-bound glycan (now containing a diagnostic anhydromannose moiety) and phosphatidylinositol. In combination with CRD antibodies, composition analyses, radioactive labeling with myo-inositol, ethanolamine, glucosamine, mannose, or fatty acids and chromatographic or detergent partitioning methods, these degradation methods represent a powerful set of tools to study GPI anchors on proteins.

Various in silico methods and algorithms have been developed that can be used to identify GPI-anchor attachment signal consensus sequences in polypeptides (see, e.g. Udenfriend et al. (1995) *Methods Enzymol.* 250:571-582; Eisenhaber et al., (1999) *J. Biol. Chem.* 292: 741-758, Kronegg and Buloz, (1999); "Detection/prediction of GPI cleavage site (GPI-anchor) in a protein (DGPI)", 129.194.185.165/dgpi/; Fankhauser et al., (2005) *Bioinformatics* 21:1846-1852; Omaetxebarria et al., (2007) *Proteomics* 7:1951-1960; Pierleoni et al., (2008) *BMC Bioinformatics* 9:392); including those that are readily available on bioinformatic websites, such as the ExPASy Proteomics tools site (expasy.ch/tools/). Thus, one of skill in the art can determine whether a PH20 polypeptide contains a GPI-anchor attachment signal sequence, and, therefore, whether the PH20 polypeptide is a GPI-anchored protein.

H. Methods of Treatment and uses of Extended Soluble PH20 and Other Soluble PH20 and Combination Therapy Various forms of PH20 hyaluronidases have been prepared and approved for therapeutic use in humans. For example, animal-derived hyaluronidase preparations include Vitrase® (ISTA Pharmaceuticals), a purified ovine testicular hyaluronidase, and Amphadase® (Amphastar Pharmaceuticals), a bovine testicular hyaluronidase. Hylenex® (Halozyme Therapeutics) is a human recombinant hyaluronidase produced by genetically engineered Chinese Hamster Ovary (CHO) cells containing nucleic acid encoding for soluble rHuPH20. Approved therapeutic uses for hyaluronidase include use as an adjuvant to increase the absorption and dispersion of other therapeutic agents, for hypodermoclysis (subcutaneous fluid administration), and as an adjunct in subcutaneous urography for improving resorption of radiopaque agents. In addition to these indications hyaluronidases can be used as a therapeutic or cosmetic agent for the treatment of additional diseases and conditions.

Hyaluronidases have also been used to enhance the activity of chemotherapeutics and/or the accessibility of tumors to chemotherapeutics (Schuller et al., 1991, *Proc. Amer. Assoc. Cancer Res.* 32:173, abstract no. 1034; Czejka et al., 1990, *Pharmazie* 45:H.9). Combination chemotherapy with hyaluronidase is effective in the treatment of a variety of cancers including urinary bladder cancer (Horn et al., 1985, *J. Surg. Oncol.* 28:304-307), squamous cell carcinoma (Kohno et al., 94, *J. Cancer Res. Oncol.* 120:293-297), breast cancer (Beckenlehner et al., 1992, *J. Cancer Res. Oncol.* 118:591-596), and gastrointestinal cancer (Scheithauer et al., 1988, *Anticancer Res.* 8:391-396). Hyaluronidase is effective as the sole therapeutic agent in the treatment of brain cancer (gliomas) (PCT published application no. WO88/02261, published Apr. 7, 1988). Administration of hyaluronidase also induces responsiveness of previously chemotherapy-resistant tumors of the pancreas, stomach, colon, ovaries, and breast (Baumgartner et al., 1988, *Reg. Cancer Treat.* 1:55-58; Zanker et al., 1986, *Proc. Amer. Assoc. Cancer Res.* 27:390). Unfortunately, the contaminants and non human nature of such hyaluronidases result in anaphylactic reactions.

In addition to its indirect anticancer effects, hyaluronidases also have direct anticarcinogenic effects. Hyaluronidase prevents growth of tumors transplanted into mice (De Maeyer et al., 1992, *Int. J. Cancer* 51:657-660) and inhibits tumor formation upon exposure to carcinogens (Pawlowski et al., 1979, *Int. J. Cancer* 23:105-109; Haberman et al., 1981, Proceedings of the 17th Annual Meeting of the American Society of Clinical Oncology, Washington, D.C., 22:105, abstract no. 415).

In particular, PH20 hyaluronidase can be used to treat hyaluronan-associated diseases or conditions associated with high interstitial fluid pressure, such as disc pressure, proliferative disorders, such as cancer and benign prostatic hyperplasia, and edema. Edema can result from or be manifested in, for example, from organ transplant, stroke or brain trauma. Proliferative disorders include, but are not limited to, cancer, smooth muscle cell proliferation, systemic sclerosis, cirrhosis of the liver, adult respiratory distress syndrome, idiopathic cardiomyopathy, lupus erythematosus, retinopathy, e.g., diabetic retinopathy or other retinopathies, cardiac hyperplasia, reproductive system associated disorders, such as benign prostatic hyperplasia (BPH) and ovarian cysts, pulmonary fibrosis, endometriosis, fibromatosis, harmatomas, lymphangiomatosis, sarcoidosis, desmoid tumors. Cancers include solid and lymphatic/blood tumors and metastatic disease, and undifferentiated tumors. The tumors amenable to treatment typically exhibit cellular and/or stromal expression of a hyaluronan, compared to a non-cancerous tissue of the same tissue type or compared to a non-metastatic tumor of the same tumor-type. Cancers include any one or more of ovarian cancer, in situ carcinoma (ISC), squamous cell carcinoma (SCC), prostate cancer, pancreatic cancer, other gastric cancers, non-small cell lung cancer, breast cancer, brain cancer and colon cancer.

Hence, PH20 hyaluronidases have multiple uses, including and in addition to their use as a spreading agent. Hyaluronidase is commonly used, for example, for peribulbar block in local anesthesia prior ophthalmic surgery. The presence of the enzyme prevents the need for additional blocks and speeds the time to the onset of akinesia (loss of eye movement). Peribulbar and sub-Tenon's block are the most common applications of hyaluronidase for ophthalmic procedures. Hyaluronidase also can promote akinesia in cosmetic surgery, such as blepharoplasties and face lifts. It is understood that soluble PH20 hyaluronidases provided herein, including esPH20 hyaluronidases, can be used in any method of treatment or combination therapy for which a PH20 hyaluronidase is used (see e.g., U.S. Publication Nos. US20040268425; US20050260186; US20060104968; and U.S. application Ser. Nos. 12/381,844, 12/386,249, 12/387, 225 and 12/386,222, incorporated by reference in their entirety). Exemplary therapeutic and cosmetic uses for hyaluronidase are described below.

1. Use as a Spreading Agent and Combination Therapy

As noted above, hyaluronidase is a spreading or diffusing substance which modifies the permeability of connective tissue through the hydrolysis of hyaluronic acid, a polysaccharide found in the intercellular ground substance of connective tissue, and of certain specialized tissues, such as the umbilical cord and vitreous humor. When no spreading factor is present, materials injected subcutaneously, such as drugs, proteins, peptides and nucleic acid, spread very slowly. Co-injection with hyaluronidase, however, can cause rapid spreading. The rate of diffusion is proportional to the amount of enzyme, and the extent of diffusion is proportional to the volume of solution.

PH20, including soluble PH20 such as esPH20 provided herein, can be used to promote or enhance the delivery agents and molecules to any of a variety of mammalian tissues in vivo. It can be used to facilitate the diffusion and, therefore, promote the delivery, of small molecule pharmacologic agents as well as larger molecule pharmacologic agents, such as proteins, nucleic acids and ribonucleic acids, and macromolecular compositions than can contain a combination of components including, but not limited to, nucleic acids, proteins, carbohydrates, lipids, lipid-based molecules and drugs (see e.g. U.S. Publication Nos. US20040268425; US20050260186; and US20060104968). PH20, including soluble PH20 such as esPH20 can be co-administered and/or co-formulated with a therapeutic agent to improve the bioavailability as well as pharmacokinetic (PK) and/or pharmacodynamic (PD) characteristics of co-formulated or co-administered agents. PK/PD parameters that can be improved by using soluble PH20, such as esPH20, include such measures as $C_{max}$ (the maximal concentration of agent achieved following absorption in, e.g., the bloodstream), $T_{max}$ (the time required to achieve maximal concentration), $T_{1/2}$ (the time required for the concentration to fall by half), $C_{min}$ (the minimal concentration of agent following metabolism and excretion), AUC (area under the curve of concentration versus time, a measure of the overall amount of bioavailability), concentrations in various tissues of interest (including, e.g., the rate of achieving desired concentrations, the overall levels, and the duration of maintaining desired levels), and $E_{max}$ (the maximal effect achieved).

The methods of treatment provided herein include combination therapies with a therapeutic agent for the treatment of a disease or disorder for which the therapeutic agent threats. Any therapeutic agent that ameliorates and or otherwise lessens the severity of a disease or condition can be combined with a soluble PH20 provided herein in order to increase the bioavailability of such therapeutic agent. In particular, soluble PH20 polypeptides provided herein, such as esPH20s, can be used in each and all of the combinations described in applications see e.g., U.S. Publication Nos. US20040268425; US20050260186; US20060104968 and U.S. application Ser. Nos. 12/381,844, 12/386,249, 12/387, 225 and 12/386,222 in place of the disclosed hyaluronidase or hyaluronidase degrading enzyme.

Soluble PH20 polypeptides provided herein, in particular esPH20 polypeptides, can be administered prior, subsequently, intermittently or simultaneously to the therapeutic agent preparation. Generally, the soluble PH20 is administered prior to or simultaneously with administration of the therapeutic agent preparation to permit the soluble PH20 to degrade the hyaluronic acid in the interstitial space. The soluble PH20 can be administered at a site different from the site of administration of the therapeutic molecule or the soluble PH20 can be administered at a site the same as the site of administration of the therapeutic molecule.

Examples of pharmaceutical, therapeutic and cosmetic agents and molecules that can be administered with hyaluronidase include, but are not limited to, a chemotherapeutic or anticancer agent, an analgesic agent, an antibiotic agent, an anti-inflammatory agent, an antimicrobial agent, an amoebicidal agent, a trichomonocidal agent, an anti-parkinson agent, an anti-malarial agent, an anticonvulsant agent, an anti-depressant agent, an anti-arthritics agent, an anti-fungal agent, an antihypertensive agent, an antipyretic agent, an anti-parasitic agent, an antihistamine agent, an alpha-adrenergic agonist agent, an alpha blocker agent, an anesthetic agent, a bronchial dilator agent, a biocide agent, a bactericide agent, a bacteriostatic agent, a beta adrenergic blocker agent, a calcium channel blocker agent, a cardiovascular drug agent, a contraceptive agent, a cosmetic or esthetic agent, a decongestant agent, a diuretic agent, a depressant agent, a diagnostic agent, an electrolyte agent, a hypnotic agent, a hormone agent, a hyperglycemic agent, a muscle relaxant agent, a muscle contractant agent, an ophthalmic agent, a parasympathomimetic agent, a psychic energizer agent, a sedative agent, a sleep inducer, a sympathomimetic agent, a tranquilizer agent, a urinary agent, a vaginal agent, a viricide agent, a vitamin agent, a non-steroidal anti-inflammatory agent, or an angiotensin converting enzyme inhibitor agent, and any combination thereof. In particular, therapeutic agents include antibodies, including monoclonal antibodies, bisphosphonates, insulins and immunoglobulins.

For example, exemplary antibiotic agents include, but are not limited to, Aminoglycosides; Amphenicols; Ansamycins; Carbacephems; Carbapenems; Cephalosporins or Cephems; Cephamycins; Clavams; Cyclic lipopeptides; Diaminopyrimidines; Ketolides; Lincosamides; Macrolides; Monobactams; Nitrofurans; Oxacephems; Oxazolidinones; Penems, thienamycins and miscellaneous beta-lactams; Penicillins; Polypeptides antibiotics; Quinolones; Sulfonamides; Sulfones; Tetracyclines; and other antibiotics (such as Clofoctols, Fusidic acids, Hexedines, Methenamines, Nitrofurantoins Nitroxolines, Ritipenems, Taurolidines, Xibomols).

Also included among exemplary therapeutic agents are blood modifiers such as antihemophilic factors, anti-inhibitor coagulant complexes, antithrombin IIIs, coagulations Factor Vhs, coagulation Factor VIIIs, coagulation Factor IXs, plasma protein fractions, von Willebrand factors; antiplatelet agents (including, for example, abciximabs, anagrelides, cilostazols, clopidogrel bisulfates, dipyridamoles, epoprostenols, eptifibatides, tirofibans; colony stimulating factors (CSFs) (including, for example, Granulocyte CSFs and Granulocyte Macrophage CSFs); erythropoiesis stimulators (including, for example, erythropoietins such as darbepoetin alfas) and epoetin alfas; hemostatics and albumins (including, for example, aprotinins, combinations of antihemophilic factors and plasma, Desmopressin Acetates, and albumins); immune globulins, as well as hepatitis B immune globulins; thrombin inhibitors (including for example direct thrombin inhibitors and lepirudin), and drotecogin alfas; anticoagulants (including, for example, dalteparins, enoxaperins and other heparins, and warfarins).

Other exemplary therapeutic agents that can be combined by co-administration and/or co-formulation with a soluble PH20, such as an esPH20, include, but are not limited to, Adalimumabs, Agalsidase Betas, Alefacepts, Ampicillins, Anakinras, Antipoliomyelitic Vaccines, Anti-Thymocytes, Azithromycins, Becaplermins, Caspofungins, Cefazolins, Cefepimes, Cefotetans, Ceftazidimes, Ceftriaxones, Cetuximabs, Cilastatins, Clavulanic Acids, Clindamycins, Darbepoetin Alfas, Deaclizumabs, Diphtheria, Diphtheria antitoxins, Diphtheria Toxoids, Efalizumabs, Epinephrines, Erythropoietin Alphas, Etanercepts, Filgrastims, Fluconazoles, Follicle-Stimulating Hormones, Follitropin Alphas, Follitropin Betas, Fosphenyloins, Gadodiamides, Gadopentetates, Gatifloxacins, Glatiramers, GM-CSF's, Goserelins, Goserelin acetates, Granisetrons, *Haemophilus Influenza* B's, Haloperidols, Hepatitis vaccines, Hepatitis A Vaccines, Hepatitis B Vaccines, Ibritumomab Tiuxetans, Ibritumomabs, Tiuxetans, Immunoglobulins, *Hemophilus influenza* vaccines, Influenza Virus Vaccines, Infliximabs, Insulins, Insulin Glargines, Interferons, Interferon alphas, Interferon Betas, Interferon Gammas, Interferon alpha-2a's, Interferon alpha-2b's, Interferon alpha-1's, Interferon alpha-n3's, Interferon Betas, Interferon Beta-1a's, Interferon Gammas, Interferon alpha-consensus, Iodixanols, Iohexols, Iopamidols, Ioversols, Ketorolacs, Laronidases, Levofloxacins, Lidocaines, Linezolids, Lorazepams, Measles Vaccines, Measles virus, Mumps viruses, Measles-Mumps-Rubella Virus Vaccines, Rubella vaccines, Medroxyprogesterones, Meropenems, Methylprednisolones, Midazolams, Morphines, Octreotides, Omalizumabs, Ondansetrons, Palivizumabs, Pantoprazoles, Pegaspargases, Pegfilgrastims, Peg-Interferon Alfa-2a's, Peg-Interferon Alfa-2b's, Pegvisomants, Pertussis vaccines, Piperacillins, Pneumococcal Vaccines and Pneumococcal Conjugate Vaccines, Promethazines, Reteplases, Somatropins, Sulbactams, Sumatriptans, Tazobactams, Tenecteplases, Tetanus Purified Toxoids, Ticarcillins, Tositumomabs, Triamcinolones, Triamcinolone Acetonides, Triamcinolone hexacetonides, Vancomycins, Varicella Zoster immunoglobulins, Varicella vaccines, other vaccines, Alemtuzumabs, Alitretinoins, Allopurinols, Altretamines, Amifostines, Anastrozoles, Arsenics, Arsenic Trioxides, Asparaginases, *Bacillus* Calmette-Guerin (BCG) vaccines, BCG Live, Bexarotenes, Bleomycins, Busulfans, Busulfan intravenous, Busulfan orals, Calusterones, Capecitabines, Carboplatins, Carmustines, Carmustines with Polifeprosans, Celecoxibs, Chlorambucils, Cisplatins, Cladribines, Cyclophosphamides, Cytarabines, Cytarabine liposomals, Dacarbazines, Dactinomycins, Daunorubicin liposomals, Daunorubicins, Daunomycins, Denileukin Diftitoxes, Dexrazoxanes, Docetaxels, Doxorubicins, Doxorubicin liposomals, Dromostanolone propionates, Elliott's B Solutions, Epirubicins, Epoetin alfas, Estramustines, Etoposides, Etoposide phosphates, Etoposide VP-16s, Exemestanes, Floxuridines, Fludarabines, Fluorouracils, 5-Fluorouracils, Fulvestrants, Gemcitabines, Gemtuzumabs, Ozogamicins, Gemtuzumab ozogamicins, Hydroxyureas, Idarubicins, Ifosfamides, Imatinib mesylates, Irinotecans, Letrozoles, Leucovorins, Levamisoles, Lomustines, CCNUs, Mechlorethamines, Nitrogen mustards, Megestrols, Megestrol acetates, Melphalans, L-PAMs, Mercaptopurines, 6-Mercaptopurines, Mesnas, Methotrexates, Methoxsalens, Mitomycins, Mitomycin C's, Mitotanes, Mitoxantrones, Nandrolones, Nandrolone Phenpropionates, Nofetumomabs, Oprelvekins, Oxaliplatins, Paclitaxels, Pamidronates, Pegademases, Pentostatins, Pipobromans, Plicamycins, Mithramycins, Porfimers, Porfimer sodiums, Procarbazines, Quinacrines, Rasburicases, Rituximabs, Sargramostims, Streptozocins, Talcs, Tamoxifens, Temozolomides, Teniposides, Testolactones, Thioguanines, 6-Thioguanines, Triethylenethiophosphoramides (Thiotepas), Topotecans, Toremifenes, Trastuzumabs, Tretinoins, Uracil Mustards, Valrubicins, Vinblastines, Vincristines, Vinorelbines, Zoledronates, Acivicins, Aclarubicins, Acodazoles, Acronines, Adozelesins, Aldesleukins, Retinoic Acids, Alitretinoins, 9-Cis-Retinoic Acids, Alvocidibs, Ambazones, Ambomycins, Ametantrones, Aminoglutethimides, Amsacrines, Anaxirones, Ancitabines, Anthramycins, Apaziquones, Argimesnas, Asperlins, Atrimustines, Azacitidines, Azetepas, Azotomycins, Banoxantrones, Batabulins, Batimastats, Benaxibines, Bendamustines, Benzodepas, Bicalutamides, Bietaserpines, Biricodars, Bisantrenes, Bisnafide Dimesylates, Bizelesins, Bortezomibs, Brequinars, Bropirimines, Budotitanes, Cactinomycins, Canertinibs, Caracemides, Carbetimers, Carboquones, Carmofurs, Carubicins, Carzelesins, Cedefingols, Cemadotins, Chiorambucils, Cioteronels, Cirolemycins, Clanfenurs, Clofarabines, Crisnatols, Decitabines, Dexniguldipines, Dexormaplatins, Dezaguanines, Diaziquones, Dibrospidiums, Dienogests, Dinalins, Disermolides, Dofequidars, Doxifluridines, Droloxifenes, Duazomycins, Ecomustines, Edatrexates, Edotecarins, Eflornithines, Elacridars, Elinafides, Elsamitrucins, Emitefurs, Enloplatins, Enpromates, Enzastaurins, Epipropidines, Eptaloprosts, Erbulozoles, Esorubicins, Etanidazoles, Etoglucids, Etoprines, Exisulinds, Fadrozoles, Fazarabines, Fenretinides, Fluoxymesterones, Fluorocitabines, Fosquidones, Fostriecins, Fotretamines, Galarubicins, Galocitabines, Geroquinols, Gimatecans, Gimeracils, Gloxazones, Glufosfamides, Ilmofosines, Ilomastats, Imexons, Improsulfans, Indisulams, Inproquones, Interleukins, Interleukin-2s, recombinant Interleukins, Intoplicines, lobenguanes, Iproplatins, Irsogladines, Ixabepilones, Ketotrexates, L-Alanosines, Lanreotides, Lapatinibs, Ledoxantrones, Leuprolides, Leuprorelins, Lexacalcitols, Liarozoles, Lobaplatins, Lometrexols, Lonafarnibs, Losoxantrones, Lurtotecans, Mafosfamides, Mannosulfans, Marimastats, Masoprocols, Maytansines, Mechiorethamines, Melengestrols, Meiphalans, Menogarils, Mepitiostanes, Metesinds, Metomidates, Metoprines, Meturedepas, Mibopl-atins, Miproxifenes, Misonidazoles, Mitindomides, Mitocarcins, Mitocromins, Mitoflaxones, Mitogillins, Mitoguazones, Mitomalcins, Mitonafides, Mitoquidones, Mitospers, Mitozolomides, Mivobulins, Mizoribines, Mofarotenes, Mopidamols, Mubritinibs, Mycophenolic Acids, Nedaplatins, Neizarabines, Nemorubicins, Nitracrines, Nocodazoles, Nogalamycins, Nolatrexeds, Nortopixantrones, Ormaplatins, Ortataxels, Oteracils, Oxisurans, Oxophenarsines, Patubilones, Peldesines, Peliomycins, Pelitrexols, Pemetrexeds, Pentamustines, Peplomycins, Perfosfamides, Perifosines, Picoplatins, Pinafides, Piposulfans, Pirfenidones, Piroxantrones, Pixantrones, Plevitrexeds, Plomestanes, Porfiromycins, Prednimustines, Propamidines, Prospidiums, Pumitepas, Puromycins, Pyrazofurins, Ranimustines, Riboprines, Ritrosulfans, Rogletimides, Roquinimexs, Rufocromomycins, Sabarubicins, Safingols, Satraplatins, Sebriplatins, Semustines, Simtrazenes, Sizofurans, Sobuzoxanes, Sorafenibs, Sparfosates, Sparfosic Acids, Sparsomycins, Spirogermaniums, Spiromustines, Spiroplatins, Squalamines, Streptonigrins, Streptovarycins, Sufosfamides, Sulofenurs, Tacedinalines, Talisomycins, Tallimustines, Tariquidars, Tauromustines, Tecogalans, Tegafurs, Teloxantrones, Temoporfins, Teroxirones, Thiamiprines, Tiamiprines, Tiazofurins, Tilomisoles, Tilorones, Timcodars, Timonacics, Tirapazamines, Topixantrones, Trabectedins, Ecteinascidin 743, Trestolones, Triciribines, Trilostanes, Trimetrexates, Triplatin Tetranitrates, Triptorelins, Trofosfamides, Tubulozoles, Ubenimexs, Uredepas, Vaispodars, Vapreotides, Verteporfins, Vinbiastines, Vindesines, Vinepidines, Vinflunines, Vinformides, Vinglycinates, Vinleucinols, Vinleurosines, Vinrosidines, Vintriptols, Vinzolidines, Vorozoles, Xanthomycin A's, Guamecyclines, Zeniplatins, Zilascorbs [2-H], Zinostatins, Zorubicins, Zosuquidars, Acetazolamides, Acyclovirs, Adipiodones, Alatrofloxacins, Alfentanils, Allergenic extracts, Alpha 1-proteinase inhibitors, Aiprostadils, Amikacins, Amino acids, Aminocaproic acids, Aminophyllines, Amitriptylines, Amobarbitals, Amrinones, Analgesics, Antipoliomyelitic vaccines, Anti-rabic serums, Anti-tetanus immunoglobulins, tetanus vaccines, Antithrombin III's, Antivenom serums, Argatrobans, Arginines, Ascorbic acids, Atenolols, Atracuriums, Atropines, Aurothioglucoses, Azathioprines, Aztreonams, Bacitracins, Baclofens, Basiliximabs, Benzoic acids, Benztropines, Betamethasones, Biotins, Bivalirudins, Botulism antitoxins, Bretyliums, Bumetanides, Bupivacaines, Buprenorphines, Butorphanols, Calcitonins, Calcitriols, Calciums, Capreomycins, Carboprosts, Carnitines, Cefaniandoles, Cefoperazones, Cefotaximes, Cefoxitins, Ceftizoximes, Cefuroximes, Chioramphenicols, Chioroprocaines, Chioroquines, Chlorothiazides, Chiorpromazines, Chondroitinsulfuric acids, Choriogonadotropin alfas, Chromiums, Cidofovirs, Cimetidines, Ciprofloxacins, Cisatracuriums, Clonidines, Codeines, Coichicines, Colistins, Collagens, Corticorelin ovine triflutates, Corticotrophins, Cosyntropins, Cyanocobalamins, Cyclosporines, Cysteines, Dacliximabs, Dalfopristins, Dalteparins, Danaparoids, Dantrolenes, Deferoxamines, Desmopressins, Dexamethasones, Dexmedetomidines, Dexpanthenols, Dextrans, Iron dextrans, Diatrizoic acids, Diazepams, Diazoxides, Dicyclomines, Digibinds, Digoxins, Dihydroergotamines, Diltiazems, Diphenhydramines, Dipyridamoles, Dobutamines, Dopamines, Doxacuriums, Doxaprams, Doxercalciferols, Doxycyclines, Droperidols, Dyphyllines, Edetic acids, Edrophoniums, Enalaprilats, Ephedrines, Epoprostenols, Ergocalciferols, Ergonovines, Ertapenems, Erythromycins, Esmolols, Estradiols, Estrogenics, Ethacrynic acids, Ethanolamines, Ethanols, Ethiodized oils, Etidronic acids, Etomidates, Factor VIII's, Famotidines, Fenoldopams, Fentanyls, Flumazenils, Fluoresceins, Fluphenazines, Folic acids, Fomepizoles, Fomivirsens, Fondaparinuxs, Foscarnets, Fosphenyloins, Furosemides, Gadoteridols, Gadoversetamides, Ganciclovirs, Gentamicins, Glucagons, Glucoses, Glycines, Glycopyrrolates, Gonadorelins, Gonadotropin chorionics, Haemophilus B polysaccharides, Hemins, Herbals, Histamines, Hydralazines, Hydrocortisones, Hydromorphones, Hydroxocobalamins, Hydroxyzines, Hyoscyamines, Ibutilides, Imiglucerases, Indigo carmines, Indomethacins, Iodides, lopromides, Iothalamic acids, loxaglic acids, loxilans, Isoniazids, Isoproterenols, Japanese encephalitis vaccines, Kanamycins, Ketamines, Labetalols, Lepirudins, Levobupivacaines, Levothyroxines, Lincomycins, Liothyronines, Luteinising hormones, Lyme disease vaccines, Mangafodipirs, Manthtols, Meningococcal polysaccharide vaccines, Meperidines, Mepivacaines, Mesoridazines, Metaraminols, Methadones, Methocarbamols, Methohexitals, Methyldopates, Methylergonovines, Metoclopramides, Metoprolols, Metronidazoles, Minocyclines, Mivacuriums, Morrhuic acids, Moxifloxacins, Muromonab-CD3s, Mycophenolate mofetils, Nafcillins, Nalbuphines, Nalmefenes, Naloxones, Neostigmines, Niacinamides, Nicardipines, Nitroglycerins, Nitroprussides, Norepinephrines, Orphenadrines, Oxacillins, Oxymorphones, Oxytetracyclines, Oxytocins, Pancuroniums, Panthenols, Pantothenic acids, Papaverines, Peginterferon-alpha (e.g. interferon alpha 2a or 2b), Penicillin Gs, Pentamidines, Pentazocines, Pentobarbitals, Perfiutrens, Perphenazines, Phenobarbitals, Phentolamines, Phenylephrines, Phenytoins, Physostigmines, Phytonadiones, Polymyxin bs, Pralidoximes, Prilocaines, Procainamides, Procaines, Prochiorperazines, Progesterones, Propranolols, Pyridostigmine hydroxides, Pyridoxines, Quinidines, Quinupristins, Rabies immunoglobulins, Rabies vaccines, Ranitidines, Remifentanils, Riboflavins, Rifampins, Ropivacaines, Samariums, Scopolamines, Seleniums, Sermorelins, Sincalides, Somatrems, Spectinomycins, Streptokinases, Streptomycins, Succinylcholines, Sufentanils, Sulfamethoxazoles, Tacrolirnuss, Terbutalines, Teriparatides, Testosterones, Tetanus antitoxins, Tetracaines, Tetradecyl sulfates, Theophyllines, Thiamines, Thiethylperazines, Thiopentals, Thyroid stimulating hormones, Tinzaparins, Tirofibans, Tobramycins, Tolazolines, Tolbutamides, Torsemides, Tranexamic acids, Treprostinils, Trifluoperazines, Trimethobenzamides, Trimethoprims, Tromethamines, Tuberculins, Typhoid vaccines, Urofollitropins, Urokinases, Vaiproic acids, Vasopressins, Vecuroniums, Verapamils, Voriconazoles, Warfarins, Yellow fever vaccines, Zidovudines, Zincs, Ziprasidone hydrochlorides, Aclacinomycins, Actinomycins, Adriamycins, Azaserines, 6-Azauridines, Carzinophilins, Chromomycins, Denopterins, 6-Diazo-5-Oxo-L-Norleucines, Enocitabines, Loxuridines, Olivomycines, Pirarubicins, Piritrexims, Pteropterins, Tagafurs, Tubercidins, Alteplases, Arcitumomabs, bevacizumabs, Botulinum Toxin Type A's, Botulinum Toxin Type B's, Capromab Pendetides, Daclizumabs, Dornase alfas, Drotrecogin alfas, Imciromab Pentetates, and Iodine-131's.

In particular, therapeutic agents include, but are not limited to, immunoglobulins, Interferon beta, Interferon alpha-2as, Interferon alpha-1s, Interferon alpha-n3s, Interferon beta-1, Interferon beta-1 as, Interferon gamma-1bs, Peg-interferon alpha-2 and Peginterferon alpha-2bs, insulin, a bisphosphate (e.g. Pamidronates or Zoledronates), Docetaxels, Doxorubincins, Doxorubicin liposomals and bevacizumabs.

2. Use to Remove Excess Glycosaminoglycanases

Provided herein are methods for treating hyaluronan-associated diseases and conditions by administration of a composition containing a soluble PH20, typically a soluble hyaluronidase either alone or in combination with or in addition to another treatment and/or agent. Hyaluronan-associated conditions and diseases are diseases and conditions in which hyaluronan levels are elevated as cause, consequence or otherwise observed in the disease or condition, and can be treated by administration of a composition hyaluronidases, such as a soluble PH20, either alone or in combination with or in addition to another treatment and/or agent.

Typically, hyaluronan-associated diseases and conditions are associated with elevated hyaluronan expression in a tissue, cell, or body fluid (e.g. tumor tissue or tumor-associated tissue, blood, or interstitial space) compared to a control, e.g. another tissue, cell or body fluid. The elevated hyaluronan expression can be elevated compared to a normal tissue, cell or body fluid, for example, a tissue, cell or body fluid that is analogous to the sample being tested, but isolated from a different subject, such as a subject that is normal (i.e. does not have a disease or condition, or does not have the type of disease or condition that the subject being tested has), for example, a subject that does not have a hyaluronan-associated disease or condition. The elevated hyaluronan expression can be elevated compared to an analogous tissue from another subject that has a similar disease or condition, but whose disease is not as severe and/or is not hyaluronan-associated or expresses relatively less hyaluronan and thus is hyaluronan-associated to a lesser degree. For example, the subject being tested can be a subject with a hyaluronan-associated cancer, where the HA amounts in the tissue, cell or fluid are relatively elevated compared to a subject having a less severe cancer, such as an early stage, differentiated or other type of cancer. In another example, the cell, tissue or fluid contains elevated levels of hyaluronan compared to a control sample, such as a fluid, tissue, extract (e.g. cellular or nuclear extract), nucleic acid or peptide preparation, cell line, biopsy, standard or other sample, with a known amount or relative amount of HA, such as a sample, for example a tumor cell line, known to express relatively low levels of HA, such as exemplary tumor cell lines described herein that express low levels of HA, for example, the HCT 116 cell line, the HT29 cell line, the NCI H460 cell line, the DU145 cell line, the Capan-1 cell line, and tumors from tumor models generated using such cell lines.

In some cases, hyaluronan-associated diseases and conditions are associated with increased interstitial fluid pressure, decreased vascular volume, and/or increased water content in a tissue, such as a tumor. In one example, treatment with the compositions and compounds provided herein ameliorates one or more of these symptoms or other symptoms associated with the disease or condition, for example, improves survival or quality of life of the subject over time, or inhibits tumor growth.

Exemplary hyaluronan-associated diseases and conditions that can be treated using the provided enzymes, compositions and methods, include, but are not limited to, hyaluronan-rich cancers, for example, tumors, including solid tumors such as late-stage cancers, a metastatic cancers, undifferentiated cancers, ovarian cancer, in situ carcinoma (ISC), squamous cell carcinoma (SCC), prostate cancer, pancreatic cancer, non-small cell lung cancer, breast cancer, colon cancer and other cancers.

Also exemplary of hyaluronan-associated diseases and conditions are diseases that are associated with elevated interstitial fluid pressure, such as diseases associated with disc pressure, and edema, for example, edema caused by organ transplant, stroke, brain trauma or other injury. Exemplary hyaluronan-associated diseases and conditions include diseases and conditions associated with elevated interstitial fluid pressure, decreased vascular volume, and/or increased water content in a tissue, including cancers, disc pressure and edema. In one example, treatment of the hyaluronan-associated condition, disease or disorder includes amelioration, reduction, or other beneficial effect on one or more of increased interstitial fluid pressure (IFP), decreased vascular volume, and increased water content in a tissue.

Typically, the hyaluronan-associated disease or condition is associated with increased HA expression, for example, in a diseased tissue, for example, a tumor. In one example, HALOs (pericellular matrix regions that are rich in proteoglycans, including hyaluronan) form in a tissue of the subject, for example, in a diseased tissue. In another example, the presence of HALOs is detected in an in vitro culture of cells from a tissue of the subject, for example, a diseased tissue.

a. Use in Cancer Treatment

Hyaluronidase has direct anticarcinogenic effects by degradation of hyaluronic acid in tumors. Thus, soluble PH20 hyaluronidases, such as esPH20, can be used to treat tumors, in particular, tumors that are hyaluronan rich. The hyaluronan-rich cancer can be a cancer in which the cancer cells produce HALOs, cancers that have elevated expression of hyaluronan (as determined by immunostaining, e.g. histological staining of sections from the tumor), cancers that have elevated HAS2 (Hyaluronan synthase 2), cancers that do not produce hyaluronidase (HYAL1) in vitro. Hyaluronan-rich cancers can be identified by any method for assessing hyaluronan expression, and other known methods for assaying protein/mRNA expression.

Several hyaluronan-rich cancers have been identified. In some cases, hyaluronan expression correlates with poor prognosis, for example, decreased survival rate and/or recurrence-free survival rate, metastases, angiogenesis, cancer cell invasion into other tissues/areas, and other indicators of poor prognosis. Such correlation has been observed, for example, in hyaluronan-rich tumors including ovarian cancer, SCC, ISC, prostate cancer, lung cancer, including non-small-cell lung cancer (NSCLC), breast cancer, colon cancer and pancreatic cancer (see, for example, Maarit et al., *Cancer Research*, 60:150-155 (2000); Karvinen et al., *British Journal of Dermatology*, 148:86-94 (2003); Lipponen et al., *Eur. Journal of Cancer*, 849-856 (2001); Pirinen et al., *Int. J. Cancer:* 95: 12-17 (2001); Auvinen et al., *American Journal of Pathology*, 156(2):529-536 (2000); Ropponen et al., *Cancer Research*, 58: 342-347 (1998)). Thus, hyaluronan-rich cancers can be treated by administration of a hyaluronidase, such as a soluble PH20, to treat one or more symptoms of the cancer. Hyaluronan-rich tumors include, but are not limited to, prostate, breast, colon, ovarian, stomach, head and neck and other tumors and cancers.

Hyaluronidases can also be used to increase the sensitivity of tumors that are resistant to conventional chemotherapy. For example, a hyaluronidase, such as soluble PH20, can be administered to a patient having a tumor associated with a HYAL1 defect in an amount effective to increase diffusion around the tumor site (e.g., to facilitate circulation and/or concentrations of chemotherapeutic agents in and around the tumor site), inhibit tumor cell motility, such as by hyaluronic acid degradation, and/or to lower the tumor cell apoptosis threshold. This can bring the tumor cell(s) to a state of anoikis, which renders the tumor cell more susceptible to the action of chemotherapeutic agents. Administration of a hyaluronidase can induce responsiveness of previously chemotherapy-resistant tumors of the pancreas, stomach, colon, ovaries, and breast (Baumgartner et al. (1988) *Reg. Cancer Treat.* 1:55-58; Zanker et al. (1986) *Proc. Amer. Assoc. Cancer Res.* 27:390). Thus, in addition to treatment of a cancer with a soluble PH20 alone, the compositions and methods provided herein also can be used to treat hyaluronan-associated cancers by administration of a soluble PH20 in combination with, for example, simultaneously or prior to, a chemotherapeutic or other anti-cancer agent or treatment. In this example, the hyaluronidase, such as a soluble PH20, typically enhances penetration of chemotherapeutic or other anti-cancer agents into solid tumors, thereby treating the disease.

Compositions containing soluble PH20 can be injected intratumorally with anti-cancer agents or intravenously for disseminated cancers or hard to reach tumors. The anticancer agent can be a chemotherapeutic, an antibody, a peptide, or a gene therapy vector, virus or DNA. Additionally, hyaluronidase can be used to recruit tumor cells into the cycling pool for sensitization in previously chemorefractory tumors that have acquired multiple drug resistance (St Croix et al., (1998) *Cancer Lett* September 131 (1): 35-44).

Exemplary anti-cancer agents that can be administered after, coincident with or before administration of a soluble PH20, such as an esPH20, include, but are not limited to Acivicins; Aclarubicins; Acodazoles; Acronines; Adozelesins; Aldesleukins; Alemtuzumabs; Alitretinoins (9-Cis-Retinoic Acids); Allopurinols; Altretamines; Alvocidibs; Ambazones; Ambomycins; Ametantrones; Amifostines; Aminoglutethimides; Amsacrines; Anastrozoles; Anaxirones; Ancitabines; Anthramycins; Apaziquones; Argimesnas; Arsenic Trioxides; Asparaginases; Asperlins; Atrimustines; Azacitidines; Azetepas; Azotomycins; Banoxantrones; Batabulins; Batimastats; BCG Live; Benaxibines; Bendamustines; Benzodepas; Bexarotenes; Bevacizumab; Bicalutamides; Bietaserpines; Biricodars; Bisantrenes; Bisantrenes; Bisnafide Dimesylates; Bizelesins; Bleomycins; Bortezomibs; Brequinars; Bropirimines; Budotitanes; Busulfans; Cactinomycins; Calusterones; Canertinibs; Capecitabines; Caracemides; Carbetimers; Carboplatins; Carboquones; Carmofurs; Carmustines with Polifeprosans; Carmustines; Carubicins; Carzelesins; Cedefingols; Celecoxibs; Cemadotins; Chlorambucils; Cioteronels; Cirolemycins; Cisplatins; Cladribines; Clanfenurs; Clofarabines; Crisnatols; Cyclophosphamides; Cytarabine liposomals; Cytarabines; Dacarbazines; Dactinomycins; Darbepoetin Alfas; Daunorubicin liposomals; Daunorubicins/Daunomycins; Daunorubicins; Decitabines; Denileukin Diftitoxes; Dexniguldipines; Dexonnaplatins; Dexrazoxanes; Dezaguanines; Diaziquones; Dibrospidiums; Dienogests; Dinalins; Disermolides; Docetaxels; Dofequidars; Doxifluridines; Doxorubicin liposomals; Doxorubicin HCL; Docorubicin HCL liposome injection; Doxorubicins; Droloxifenes; Dromostanolone Propionates; Duazomycins; Ecomustines; Edatrexates; Edotecarins; Eflornithines; Elacridars; Elinafides; Elliott's B Solutions; Elsamitrucins; Emitefurs; Enloplatins; Enpromates; Enzastaurins; Epipropidines; Epirubicins; Epoetin alfas; Eptaloprosts; Erbulozoles; Esorubicins; Estramustines; Etanidazoles; Etoglucids; Etoposide phosphates; Etoposide VP-16s; Etoposides; Etoprines; Exemestanes; Exisulinds; Fadrozoles; Fazarabines; Fenretinides; Filgrastims; Floxuridines; Fludarabines; Fluorouracils; 5-fluorouracils; Fluoxymesterones; Fluorocitabines; Fosquidones; Fostriecins; Fostriecins; Fotretamines; Fulvestrants; Galarubicins; Galocitabines; Gemcitabines; Gemtuzumabs/Ozogamicins; Geroquinols; Gimatecans; Gimeracils; Gloxazones; Glufosfamides; Goserelin acetates; Hydroxyureas; Ibritumomabs/Tiuxetans; Idarubicins; Ifosfamides; Ilmofosines; Ilomastats; Imatinib mesylates; Imexons; Improsulfans; Indisulams; Inproquones; Interferon alfa-2 as; Interferon alfa-2bs; Interferon Alfas; Interferon Betas; Interferon Gammas; Interferons; Interleukin-2s and other Interleukins (including recombinant Interleukins); Intoplicines; Iobenguanes [131-I]; Iproplatins; Irinotecans; Irsogladines; Ixabepilones; Ketotrexates; L-Alanosines; Lanreotides; Lapatinibs; Ledoxantrones; Letrozoles; Leucovorins; Leuprolides; Leuprorelins (Leuprorelides); Levamisoles; Lexacalcitols; Liarozoles; Lobaplatins; Lometrexols; Lomustines/CCNUs; Lomustines; Lonafarnibs; Losoxantrones; Lurtotecans; Mafosfamides; Mannosulfans; Marimastats; Masoprocols; Maytansines; Mechlorethamines; Mechlorethamines/Nitrogen mustards; Megestrol acetates; Megestrols; Melengestrols; Melphalans; MelphalanslL-PAMs; Menogarils; Mepitiostanes; Mercaptopurines; 6-Mercaptopurine; Mesnas; Metesinds; Methotrexates; Methoxsalens; Metomidates; Metoprines; Meturedepas; Miboplatins; Miproxifenes; Misonidazoles; Mitindomides; Mitocarcins; Mitocromins; Mitoflaxones; Mitogillins; Mitoguazones; Mitomalcins; Mitomycin Cs; Mitomycins; Mitonafides; Mitoquidones; Mitospers; Mitotanes; Mitoxantrones; Mitozolomides; Mivobulins; Mizoribines; Mofarotenes; Mopidamols; Mubritinibs; Mycophenolic Acids; Nandrolone Phenpropionates; Nedaplatins; Nelzarabines; Nemorubicins; Nitracrines; Nocodazoles; Nofetumomabs; Nogalamycins; Nolatrexeds; Nortopixantrones; Octreotides; Oprelvekins; Ormaplatins; Ortataxels; Oteracils; Oxaliplatins; Oxisurans; Oxophenarsines; Paclitaxels; Pamidronates; Patubilones; Pegademases; Pegaspargases; Pegfilgrastims; Peldesines; Peliomycins; Pelitrexols; Pemetrexeds; Pentamustines; Pentostatins; Peplomycins; Perfosfamides; Perifosines; Picoplatins; Pinafides; Pipobromans; Piposulfans; Pirfenidones; Piroxantrones; Pixantrones; Plevitrexeds; Plicamycid Mithramycins; Plicamycins; Plomestanes; Plomestanes; Porfimer sodiums; Porfimers; Porfiromycins; Prednimustines; Procarbazines; Propamidines; Prospidiums; Pumitepas; Puromycins; Pyrazofurins; Quinacrines; Ranimustines; Rasburicases; Riboprines; Ritrosulfans; Rituximabs; Rogletimides; Roquinimexs; Rufocromomycins; Sabarubicins; Safingols; Sargramostims; Satraplatins; Sebriplatins; Semustines; Simtrazenes; Sizofurans; Sobuzoxanes; Sorafenibs; Sparfosates; Sparfosic Acids; Sparsomycins; Spirogermaniums; Spiromustines; Spiroplatins; Spiroplatins; Squalamines; Streptonigrins; Streptovarycins; Streptozocins; Sufosfamides; Sulofenurs; Sunitinib Malate; 6-TG; Tacedinalines; Talcs; Talisomycins; Tallimustines; Tamoxifens; Tariquidars; Tauromustines; Tecogalans; Tegafurs; Teloxantrones; Temoporfins; Temozolomides; Teniposides/VM-26s; Teniposides; Teroxirones; Testolactones; Thiamiprines; Thioguanines; Thiotepas; Tiamiprines; Tiazofurins; Tilomisoles; Tilorones; Timcodars; Timonacics; Tirapazamines; Topixantrones; Topotecans; Toremifenes; Tositumomabs; Trabectedins (Ecteinascidin 743); Trastuzumabs; Trestolones; Tretinoins/ATRA; Triciribines; Trilostanes; Trimetrexates; Triplatin Tetranitrates; Triptorelins; Trofosfamides; Tubulozoles; Ubenimexs; Uracil Mustards; Uredepas; Valrubicins; Valspodars; Vapreotides; Verteporfins; Vinblastines; Vincristines; Vindesines; Vinepidines; Vinflunines; Vinformides; Vinglycinates; Vinleucinols; Vinleurosines; Vinorelbines; Vinrosidines; Vintriptols; Vinzolidines; Vorozoles; Xanthomycin A's (Guamecyclines); Zeniplatins; Zilascorbs [2-H]; Zinostatins; Zoledronate; Zorubicins; and Zosuquidars, for example:

Aldesleukins (e.g. PROLEUKIN®); Alemtuzumabs (e.g. CAMPATH®); Alitretinoins (e.g. PANRETIN®); Allopurinols (e.g. ZYLOPRIM®); Altretamines (e.g. HEXALEN®); Amifostines (e.g. ETHYOL®); Anastrozoles (e.g. ARIMIDEX®); Arsenic Trioxides (e.g. TRISENOX®); Asparaginases (e.g. ELSPAR®); BCG Live (e.g. TICE® BCG); Bexarotenes (e.g. TARGRETIN®); Bevacizumab (AVASTIN®); Bleomycin (e.g. BLENOXANE®); Busulfan intravenous (e.g. BUSULFEX®); Busulfan orals (e.g. MYLERANT™); Calusterones (e.g. METHOSARB®); Capecitabines (e.g. XELODA®); Carboplatins (e.g. PARAPLATIN®); Carmustines (e.g. BCNU®, BiCNU®); Carmustines with Polifeprosans (e.g. GLIADEL® Wafer); Celecoxibs (e.g. CELEBREX®); Chlorambucils (e.g. LEUKERAN®); Cisplatins (e.g. PLATINOL®); Cladribines (e.g. LEUSTATIN®, 2-CdA®); Cyclophosphamides (e.g. CYTOXAN®, NEOSAR®); Cytarabines (e.g. CYTOSAR-U®); Cytarabine liposomals (e.g. DepoCyt®); Dacarbazines (e.g. DTIC-Domeυ): Dactinomycins (e.g. COSMEGEN®); Darbepoetin Alfas (e.g. ARANESP®); Daunorubicin liposomals (e.g. DANUOXOME®); Daunorubicins/Daunomycins (e.g. CERUBIDINE®); Denileukin Diftitoxes (e.g. ONTAK®); Dexrazoxanes (e.g. ZINECARD®); Docetaxels (e.g. TAXOTERE®); Doxorubicins (e.g. ADRIAMYCIN®, RUBEX®); Doxorubicin liposomals, including Docorubicin HCL liposome injections (e.g. DOXIL®); Dromostanolone propionates (e.g. DROMOSTANOLONE® and MASTERONE® Injection); Elliott's B Solutions (e.g. Elliott's B Solution®); Epirubicin (e.g. ELLENCE®); Epoetin alfas (e.g. EPOGEN®); Estramustines (e.g. EMCYT®); Etoposide phosphates (e.g. ETOPOPHOS®); Etoposide VP-16s (e.g. VEPESID®); Exemestanes (e.g. AROMASIN®); Filgrastims (e.g. NEUPOGEN®); Floxuridines (e.g. FUDR®); Fludarabines (e.g. FLUDARA®); Fluorouracils incl. 5-FUs (e.g. ADRUCIL®); Fulvestrants (e.g. FASLODEX®); Gemcitabines (e.g. GEMZAR®); Gemtuzumabs/Ozogamicins (e.g. MYLOTARG®); Goserelin acetates (e.g. ZOLADEX®); Hydroxyureas (e.g. HYDREA®); Ibritumomabs/Tiuxetans (e.g. ZEVALIN®); Idarubicins (e.g. IDAMYCIN®); Ifosfamides (e.g. IFEX®); Imatinib mesylates (e.g. GLEEVEC®); Interferon alfa-2 as (e.g. ROFERON-A®); Interferon alfa-2bs (e.g. INTRON A®); Irinotecans (e.g. CAMPTOSAR®); Letrozoles (e.g. FEMARA®); Leucovorins (e.g. WELLCOVORIN®, LEUCOVORIN®); Levamisoles (e.g. ERGAMISOL®); Lomustines/CCNUs (e.g. CeeBU®); Mechlorethamines/Nitrogen mustards (e.g. MUSTARGEN®); Megestrol acetates (e.g. MEGACE®); Melphalans/L-PAMs (e.g. ALKERAN®); Mercaptopurine incl. 6-MPs (e.g. PURINETHOL®); Mesnas (e.g. MESNEX®); Methotrexates; Methoxsalens (e.g. UVADEX®); Mitomycin Cs (e.g. MUTAMYCIN®, MITOZYTREX®); Mitotanes (e.g. LYSODREN®); Mitoxantrones (e.g. NOVANTRONE®); Nandrolone Phenpropionates (e.g. DURABOLIN-50®); Nofetumomabs (e.g. VERLUMA®); Oprelvekins (e.g. NEUMEGA®); Oxaliplatins (e.g. ELOXATIN®); Paclitaxels (e.g. PAXENE®, TAXOL®); Pamidronates (e.g. AREDIA®); Pegademases (e.g. ADAGEN®); Pegaspargases (e.g. ONCASPAR®); Pegfilgrastims (e.g. NEULASTA®); Pentostatins (e.g. NIPENT®); Pipobromans (e.g. VERCYTE®); Plicamycin/Mithramycins (e.g. MITHRACIN®); Porfimer sodiums (e.g. PHOTOFRIN®); Procarbazines (e.g. MATULANE®); Quinacrines (e.g. ATABRINE®); Rasburicases (e.g. ELITEK®); Rituximabs (e.g. RITUXAN®); Sargramostims (e.g. PROKINE®); Streptozocins (e.g. ZANOSAR®); Sunitinib Malates (e.g. SUTENT®); Talcs (e.g. SCLEROSOL®); Tamoxifen (e.g. NOLVADEX®); Temozolomides (e.g. TEMODAR®); Teniposides/VM-26s (e.g. VUMON®); Testolactones (e.g. TESLAC®); Thioguanines incl. 6-TG; Thiotepas (e.g. THIOPLEX®); Topotecans (e.g. HYCAMTIN®); Toremifenes (e.g. FARESTON®); Tositumomabs (e.g. BEXXAR®); Trastuzumabs (e.g. HERCEPTIN®); Tretinoins/ATRA (e.g. VESANOID®); Uracil Mustards; Valrubicins (e.g. VALSTAR®); Vinblastines (e.g. VELBAN®); Vincristines (e.g. ONCOVIN®); Vinorelbines (e.g. NAVELBINE®); and Zoledronates (e.g. ZOMETA®).

In one example, a soluble PH20, such as an esPH20, for example, PEGylated rHuPH20, is administered to a subject after, coincident with or before administration of one or more of docetaxel (e.g. TAXOTERE®), Doxorubicin liposomal (e.g. DOXIL®), Sunitinib Malate (e.g. SUTENT®) or Bevacizumab (AVASTIN®).

Hence, soluble PH20 polypeptides provided herein can be used in the treatment of metastatic and non-metastatic cancers, including those that have decreased endogenous hyaluronidase activity relative to non-cancerous cells. Hyaluronidases can be used as a chemotherapeutic agent alone or in combination with other chemotherapeutics. Exemplary cancers include, but are not limited to, small lung cell carcinoma, squamous lung cell carcinoma, and cancers of the breast, ovaries, head and neck, or any other cancer associated with depressed levels of hyaluronidase activity or decreased hyaluronic acid catabolism.

b. Use in Treatment of Glycosaminoglycan Accumulation in the Brain

Hyaluronic acid levels are elevated in a number of cerebrospinal pathologic conditions. Levels of cerebrospinal hyaluronic acid are normally less than 200 µg/L in adults (Laurent et al. (1996) *Acta Neurol Scand September* 94 (3): 194-206), but can elevate to levels of over 8000 µg/L in diseases such as meningitis, spinal stenosis, head injury and cerebral infarction. Hyaluronidases, such as, for example, soluble rHuPH20, can be utilized to degrade critically elevated levels of substrate.

The lack of effective lymphatics in the brain also can lead to life threatening edema following head trauma. Hyaluronic acid accumulation is a result of increased synthesis by hyaluronic acid synthases and decreased degradation. Accumulation of hyaluronic acid can initially serve the beneficial purpose of increasing water content in the damaged tissue to facilitate leukocyte extravasation, but continued accumulation can be lethal. Administration of hyaluronidase, such as intrathecally or intravenously, to a patient suffering from head trauma can serve to remove tissue hyaluronic acid accumulation and the water associated with it.

Soluble PH20 also can be used in the treatment of edema associated with brain tumors, particularly that associated with glioblastoma multiform. The edema associated with brain tumors results from the accumulation of hyaluronic acid in the non-cancerous portions of the brain adjacent the tumor. Administration of a soluble PH20 hyaluronidase to the sites of hyaluronic acid accumulation (e.g., by intravenous injection or via a shunt) can relieve the edema associated with such malignancies by degrading the excess hyaluronic acid at these sites.

c. Use in Treatment of Glycosaminoglycan Accumulation in Cardiovascular Disease

Soluble PH20 hyaluronidases can be used in the treatment of some cardiovascular disease. Administration of hyaluronidase in animal models following experimental myocardial infarct can reduce infarct size (Maclean, et al (1976) *Science* 194 (4261):199-200). One proposed mechanism by which this can occur is by reducing hyaluronic acid accumulation that occurs following ischemia reperfusion. Reduction of infarct size is believed to occur from increased lymph drainage and increased tissue oxygenation and reduction of myocardial water content.

Soluble PH20 hyaluronidases also can be used to limit coronary plaques from arteriosclerosis. Such plaques accumulate glycosaminoglycans and mediate macrophage and foam cell adhesion (Kolodgie et al. (2002) *Arterioscler Thromb Vasc Biol.* 22 (10):1642-8).

d. Use In Vitrectomy and Ophthalmic Disorders and Conditions

Hyaluronidase, such as a soluble PH20, can be used to minimize the detachment or tearing of the retina during vitrectomy. This could cause, for example, the vitreous body to become uncoupled or "disinserted" from the retina, prior to removal of the vitreous body. Such disinsertion or uncoupling of the vitreous body can minimize the likelihood that further tearing or detachment of the retina will occur as the vitreous body is removed.

Hyaluronidase, such as a soluble PH20, can be used for various ophthalmic applications, including the vitrectomy adjunct application described in U.S. Pat. No. 5,292,509. The use of a highly purified hyaluronidase, such as, for example, soluble PH20 provided herein, is preferable for intraocular procedures to minimize immunogenicity and toxicity.

Soluble PH20 hyaluronidases can be used to treat and/or prevent ophthalmic disorders by, for example, preventing neovascularization and increasing the rate of clearance from the vitreous of materials toxic to the retina. A soluble PH20 hyaluronidase can be administered in an amount effective to liquefy the vitreous humor of the eye without causing toxic damage to the eye. Liquefaction of the vitreous humor increases the rate of liquid exchange from the vitreal chamber. This increase in exchange removes the contaminating materials whose presence can cause ophthalmologic and retinal damage.

Soluble PH20 hyaluronidases also can be used to reduce postoperative pressure. Hyaluronic acid has been used in eye primarily as a spacer during cataract and intraocular lens surgical procedures. It also is used in other ocular surgical procedures such as glaucoma, vitreous and retina surgery and in corneal transplantation. A common side effect occurring in postoperative cataract patients is a significant early, and occasionally prolonged, rise in intraocular pressure. Such a condition is sometimes serious, especially in patients with glaucomatous optic disc changes. Hyaluronidase, such as soluble PH20, can be co-administered with hyaluronic acid to the eye prior to surgery to reduce postoperative pressure in the eye. The hyaluronidase is administered in an amount effective to reduce the intraocular pressure to pre-operative levels by breaking down the hyaluronic acid without decreasing its effectiveness during surgery nor causing side effects in the patient (U.S. Pat. No. 6,745,776).

Soluble PH20 hyaluronidases also can be administered to patients with glaucoma to remove glycosaminoglycans from the trabecular meshwork and reduce intraocular pressure, and can be applied to the vitreous to promote the resolution of vitreous hemorrhages (i.e. extravasation of blood into the vitreous), which can occur in connection with conditions such as diabetic retinopathy, retinal neovascularization, retinal vein occlusion, posterior vitreous detachment, retinal tears, ocular traumas and the like. The presence of vitreous hemorrhages, which are typically slow to resolve, can delay, complicate or prevent procedures that require the retina to be visualized through the vitreous for diagnosis and/or for treatment procedures such as laser photocoagulation and the like which are often primary treatments for conditions such as proliferative diabetic retinopathy.

e. Use in Hypodermoclysis

Hypodermoclysis, the infusion of fluids and electrolytes into the hypodermis of the skin, is a useful and simple hydration technique suitable for mildly to moderately dehydrated adult patients, especially the elderly. Although considered safe and effective, the most frequent adverse effect is mild subcutaneous edema that can be treated by local massage or systemic diuretics. Approximately 3 L can be given in a 24-hour period at two separate sites. Common infusion sites include the chest, abdomen, thighs and upper arms. Solutions used in hypodermoclysis include, for example, normal saline, half-normal saline, glucose with saline and 5% glucose. Potassium chloride also can be added to the solution. The addition of a hyaluronidase, such as a soluble PH20, to the solution can enhance fluid absorption and increase the overall rate of administration.

f. Use in Gene Therapy

The efficacy of most gene delivery vehicles in vivo does not correspond to the efficacy found observed in vitro. Glycosaminoglycans can hinder the transfer and diffusion of DNA and viral vectors into many cell types. The levels such extracellular matrix material can hinder the process considerably. Administration of hyaluronidase, such as a soluble PH20, can open channels in the extracellular matrix, thus enhancing delivery of gene therapy. For example, soluble PH20 can be administered with collagenase to facilitate transduction of DNA in vivo (Dubensky et al. (1984) *Proc Natl Acad Sci USA* 81 (23):7529-33). Hyaluronidase also can enhance gene therapy using adeno-associated virus (Favre et al, (2000) *Gene Therapy* 7 (16):1417-20). The channels opened following administration of hyaluronidase are of a size that typically enhance diffusion of smaller molecules such as retroviruses, adenoviruses, adeno-associated viruses and DNA complexes (as well as other therapeutic and pharmacological agents of interest). The pores are not so large, however, as to promote the dislocation and movement of cells.

In some examples, viruses can be engineered to express hyaluronidase, such as a soluble PH20, to facilitate their replication and spread within a target tissue. The target tissue can be, for example, a cancerous tissue whereby the virus is capable of selective replication within the tumor. The virus also can be a non-lytic virus wherein the virus selectively replicates under a tissue specific promoter. As the viruses replicate, the co-expression of hyaluronidase with viral genes can facilitate the spread of the virus in vivo.

g. Cosmetic Uses

Hyaluronidases, such as a soluble PH20, can be by administered to remove glycosaminoglycans involved in the accumulation of cellulite and to promote lymphatic flow. For example, soluble PH20 can be used for the treatment of cellulite. The hyaluronidase can be administered through repeated subcutaneous injections, through transdermal delivery in the form of ointments or creams or through the use of injectable slow release formulations to promote the continual degradation of glycosaminoglycans and prevent their return.

Hyaluronidase, such as a soluble PH20, also can be used to treat conditions such as "pigskin" edema or "orange peel" edema. Hyaluronidases can effect depolymerization of the long mucopolysaccharide chains that can accumulate in the dermis and which are responsible for the retention of bound water and of the slowing, by capillary compression, of the diffusion of organic liquids, which eliminate metabolic wastes. Such retention of water and wastes associated with fat overloading of the lipocytes, constitutes classical "pigskin" edema or "orange peel" edema. Depolymerization can cut the long chains of mucopolysaccharides into shorter chains, resulting in the elimination of the bound water and wastes and restoration of the venous and lymphatic circulation, culminating in the disappearance of local edema.

h. Use in Organ Transplantation

The content of hyaluronic acid in an organ can increase with inflammation. An increased concentration of hyaluronic acid has been observed in tissue from different organs characterized by inflammatory-immunological injury such as alveolitis (Nettelbladt et al. (1991) *Am. Rev. Resp. Dis.* 139: 759-762) and myocardial infarction (Waldenstrom et al. (1991) *J. Clin. Invest.* 88(5): 1622-1628). Other examples include allograft rejection after a renal (Hallgren et al. (1990) *J. Exp. Med.* 171: 2063-2076; Wells et al. (1990) *Transplantation* 50: 240-243), small bowel (Wallander et al. (1993) *Transplant. Int.* 6: 133-137) or cardiac (Hallgren et al. (1990) *J Clin Invest* 85:668-673) transplantation; or a myocardial inflammation of viral origin (Waldenstrom et al. (1993) *Eur. J. Clin. Invest.* 23: 277-282). The occurrence of interstitial edemas in connection with the grafting of an organ constitutes a severe problem in the field of transplantation surgery. Grafts with interstitial edemas can swell to such a degree that the function is temporarily be lost. In some instances, the swelling can cause disruption of the kidney, resulting in a massive hemorrhage. Hyaluronidases, such as a soluble PH20, can be used to degrade accumulated glycosaminoglycans in an organ transplant. Removal of such glycosaminoglycans promotes removal of water from the graft and thus enhances organ function.

i. Use in Pulmonary Disease

Levels of hyaluronic acid in broncheoalveolar lavages (BAL) from normal individuals are generally below 15 ng/ml. Hyaluronic acid levels in BAL rise dramatically in conditions of respiratory distress (Bjermer et al. (1987) *Br Med J (Clin Res Ed)* 295 (6602):803-6). The increased hyaluronic acid in the lung can prevent oxygen diffusion and gas exchange as well as activating neutrophil and macrophage responses. Purified preparations of soluble PH20, such as any provided herein, can be delivered by either pulmonary or intravenous delivery to patients presenting with such conditions to reduce hyaluronan levels. Hyaluronidases, such as a soluble PH20, also can be administered to patients suffering from other pulmonary complications that are associated with elevated glycosaminoglycans or to enhance the delivery of other co delivered molecules to the lung.

3. Other Uses

In further examples of its therapeutic use, hyaluronidase, such as a soluble PH20 including esPH20 provided herein, can be used for such purposes as an antidote to local necrosis from paravenous injection of necrotic substances such as vinka alkaloids (Few et al. (1987) *Amer. J. Matern. Child Nurs.* 12, 23-26), treatment of ganglion cysts (Paul et al. (1997) *J Hand Surg.* 22 (2): 219-21) and treatment of tissue necrosis due to venous insufficiency (Elder et al. (1980) *Lancet* 648-649). Soluble PH20 also can be used to treat ganglion cysts (also known as a wrist cyst, Bible cyst, or dorsal tendon cyst), which are the most common soft tissue mass of the hand and are fluid filled sacs that can be felt below the skin.

Hyaluronidases, such as soluble PH20, can be used in the treatment of spinal cord injury by degrading chondroitin sulfate proteoglycans (CSPGs). Following spinal cord injury, glial scars containing CSPGs are produced by astrocytes. CSPGs play a crucial role in the inhibition of axon growth. In addition, the expression of CSPG has been shown to increase following injury of the central nervous system (CNS). Soluble PH20 also can be utilized for the treatment of herniated disks in a process known as chemonucleolysis. Chondroitinase ABC, an enzyme cleaving similar substrates as hyaluronidase, can induce the reduction of intradiscal pressure in the lumbar spine. There are three types of disk injuries. A protruded disk is one that is intact but bulging. In an extruded disk, the fibrous wrapper has torn and the NP has oozed out, but is still connected to the disk. In a sequestered disk, a fragment of the NP has broken loose from the disk and is free in the spinal canal. Chemonucleolysis is typically effective on protruded and extruded disks, but not on sequestered disk injuries.

I. Examples

The following examples are included for illustrative purposes only and are not intended to limit the scope of the invention.

Example 1

Generation of Human PH20 Hyaluronidase Carboxy-Terminus Deletion Mutants

In this example, a series of human PH20 hyaluronidase carboxy-terminus deletion mutants were generated. Mature human PH20 hyaluronidase, or sperm adhesion molecule 1 (SPAM1), contains 474 amino acids while the mature carboxy-terminus deletion mutants generated in this example ranged in length from 472 amino acids to 415 amino acids.

DNA oligonucleotides encoding truncated human PH20 hyaluronidase carboxy-terminus deletion mutants from amino acid A507 to amino acid K450 were synthesized according to standard DNA synthesis protocols. The parent DNA sequence was a codon-optimized human PH20 hyaluronidase, the nucleotide sequence of which is set forth in SEQ ID NO:2. This codon-optimized human PH20 hyaluronidase contained an heterologous immunoglobulin kappa (IgK) signal sequence, set forth in SEQ ID NO:144. Additionally, the sequences contained a 5' NheI and a 3' BamHI restriction site to allow cloning into the HZ24 plasmid (SEQ ID NO:140). The human PH20 hyaluronidase carboxy-terminus deletion mutant nucleotide sequences are set forth in SEQ ID NOS: 146-185 and 199-201. The synthetic DNA sequences were digested with NheI and BamHI restriction enzymes and cloned into a similarly digested HZ24 plasmid to generate a mutant SPAM1-HZ24 plasmid for each individual clone.

The human PH20 hyaluronidase carboxy-terminus deletion mutants are set forth in Table 3. The SPAM1 mutants are identified by the 4 amino acids at the C-terminal end of the proteins. Also set forth are the length, in amino acids, of the precursor and mature carboxy-terminus deletion mutants.

TABLE 3

Human PH20 hyaluronidase carboxy-terminus deletion mutants.

| Mutant | Precursor (amino acids) | Precursor SEQ ID NO | Mature (amino acids) | Mature SEQ ID NO |
|---|---|---|---|---|
| SPAM1-VASL | 509 | 1 | 474 | 108 |
| SPAM1-SSVA | 507 | 3 | 472 | 55 |
| SPAM1-IISS | 505 | 4 | 470 | 56 |
| SPAM1-FLII | 503 | 5 | 468 | 57 |
| SPAM1-LFLI | 502 | 47 | 467 | 99 |
| SPAM1-ILFL | 501 | 6 | 466 | 58 |
| SPAM1-SILF | 500 | 48 | 465 | 100 |
| SPAM1-VSIL | 499 | 7 | 464 | 59 |
| SPAM1-IVSI | 498 | 49 | 463 | 101 |
| SPAM1-FIVS | 497 | 8 | 462 | 60 |
| SPAM1-TMFI | 495 | 9 | 460 | 61 |
| SPAM1-SATM | 493 | 10 | 458 | 62 |
| SPAM1-TLSA | 491 | 11 | 456 | 63 |
| SPAM1-PSTL | 489 | 12 | 454 | 64 |
| SPAM1-STLS | 490 | 13 | 455 | 65 |

TABLE 3-continued

Human PH20 hyaluronidase carboxy-terminus deletion mutants.

| Mutant | Precursor (amino acids) | Precursor SEQ ID NO | Mature (amino acids) | Mature SEQ ID NO |
|---|---|---|---|---|
| SPAM1-ASPS | 487 | 14 | 452 | 66 |
| SPAM1-YNAS | 485 | 15 | 450 | 67 |
| SPAM1-FYNA | 484 | 16 | 449 | 68 |
| SPAM1-IFYN | 483 | 17 | 448 | 69 |
| SPAM1-QIFY | 482 | 18 | 447 | 70 |
| SPAM1-PQIF | 481 | 19 | 446 | 71 |
| SPAM1-EPQI | 480 | 20 | 445 | 72 |
| SPAM1-EEPQ | 479 | 21 | 444 | 73 |
| SPAM1-TEEP | 478 | 22 | 443 | 74 |
| SPAM1-ETEE | 477 | 23 | 442 | 75 |
| SPAM1-METE | 476 | 24 | 441 | 76 |
| SPAM1-PMET | 475 | 25 | 440 | 77 |
| SPAM1-PPME | 474 | 26 | 439 | 78 |
| SPAM1-KPPM | 473 | 27 | 438 | 79 |
| SPAM1-LKPP | 472 | 28 | 437 | 80 |
| SPAM1-FLKP | 471 | 29 | 436 | 81 |
| SPAM1-AFLK | 470 | 30 | 435 | 82 |
| SPAM1-DAFL | 469 | 31 | 434 | 83 |
| SPAM1-IDAF | 468 | 32 | 433 | 84 |
| SPAM1-CIDA | 467 | 33 | 432 | 85 |
| SPAM1-VCID | 466 | 34 | 431 | 86 |
| SPAM1-GVCI | 465 | 35 | 430 | 87 |
| SPAM1-DGVC | 464 | 36 | 429 | 88 |
| SPAM1-IADG | 462 | 37 | 427 | 89 |
| SPAM1-VCIA | 460 | 38 | 425 | 90 |
| SPAM1-VDVC | 458 | 39 | 423 | 91 |
| SPAM1-DAVD | 456 | 40 | 421 | 92 |
| SPAM1-DTDA | 454 | 41 | 419 | 93 |
| SPAM1-VKDT | 452 | 42 | 417 | 94 |
| SPAM1-ADVK | 450 | 43 | 415 | 95 |

Example 2

Expression of Human PH20 Hyaluronidase Carboxy-Terminus Deletion Mutants

In this example, the human PH20 hyaluronidase carboxy-terminus deletion mutants generated in Example 1 were expressed in CHO—S cells. Additionally, rHuPH20 and His-tagged PH20 were expressed in each of four strains of lectin resistant CHO mutants, including Lec1 (Cat No. CRL-1735, ATCC), Lec2 (Cat No. CRL-1736, ATCC), Lec8 (Cat No. CRL-1737, ATCC) and Pro-5 (Cat No. CRL-1781). The expression of PH20 in Lec mutant cells is further discussed in Example 9 below.

A. Transient Expression in CHO—S Cells in 6-Well Plates

The mutant PH20-HZ24 plasmids generated in Example 1 were transiently infected into CHO—S cells (derived from Chinese Hamster Ovary CHO K1 cells) using GeneJuice® (Novagen) according to the manufacturer's instructions. In short, the CHO—S cells were grown in CD CHO medium supplemented with L-glutamine. Prior to transfection, the CHO—S cells were plated in 6-well plates, with approximately 5×10⁵ cells per well, and grown overnight at 37° C. with 5% $CO_2$. The medium was then removed and the CHO—S cells were washed 2 times with 1 mL serum-free medium. GeneJuice® was mixed with serum-free media followed by the addition of 2 µg mutant-HZ24 DNA. After incubating at room temperature for 5-15 minutes, the GeneJuice®/DNA mixture was added dropwise to an individual well containing the washed CHO—S cells. After 4 hours, the medium was replaced with 1 mL CD-CHO medium supplemented with L-glutamine and the cells were incubated for 72 hours at 37° C. with 5% $CO_2$. Following expression, the media and cells were harvested separately.

B. Transient Expression in CHO Cells in 10 Cm Cell Culture Dishes

The mutant PH20-HZ24 plasmids generated in Example 1 were transiently infected into CHO—S cells using GeneJuice® (Novagen) according to the manufacturer's instructions. Alternatively, HZ24-PH20, (SEQ ID NO:108, encoding rHuPH20), PH20sHis, (SEQ ID NO:187, encoding his-tagged PH20) and HZ24-mut(B/S) (SEQ ID NO:122, encoding PH20 truncated at amino acid 482), were transiently infected into four strains of lectin resistant CHO mutants, including Lec1 (Cat No. CRL-1735, ATCC), Lec2 (Cat No. CRL-1736, ATCC), Lec8 (Cat No. CRL-1737, ATCC) and Pro-5 (Cat No. CRL-1781), using GeneJuice® (Novagen) according to the manufacturer's instructions.

In short, CHO—S cells were maintained in CD-CHO medium supplemented with 8 mM GlutaMax. Lectin resistant CHO mutant cells were grown in DMEM medium supplemented with 10% FBS. Prior to transfection, the CHO cells were plated in 10 cm cell culture dishes, with approximately 3×10⁶ cells per well and grown overnight in DMEM medium supplemented with 10% FBS at 37° C. with 5% $CO_2$. The medium was then removed and the monolayer of cells was washed 2 times with 10 mL serum-free medium. 36 µL GeneJuice® was mixed with 1.2 mL DMEM and incubated at room temperature for 5 minutes. Following incubation, 12 µg DNA was added and mixed gently. After incubating at room temperature for 15 minutes, the GeneJuice®/DNA mixture was added dropwise the monolayer of CHO cells and the cell culture dish was shaken gently to allow for mixing. The plate was incubated for 4 hours at 37° C. with 5% $CO_2$. After 4 hours, the medium was replaced with 12 mL detergent free CD DG44 medium supplemented with Glutamax-1 and the cells were incubated for 48 hours at 37° C. with 5% $CO_2$. Following expression, the media and cells were harvested separately.

Example 3

Solubility of Human PH20 Hyaluronidase Carboxy-Terminus Deletion Mutants

In this example, following transient expression, as described in Example 2 above, the media and cells were harvested separately and analyzed for PH20 expression and solubility by Western blot analysis. Solubility of the C-terminus truncation mutants was determined by examining whether the expressed protein was present in the growth media or in the cells. C-terminus deletion mutants from 455 to 472 amino acids in length, corresponding to SEQ ID NOS: 55-65 and 99-101, contain amino acid residues from the GPI-anchor which serves to attach the protein to the cell membrane. Cells expressing these mutants were treated with phosphoinositol-phospholipase C (PI-PLC), which cleaves the GPI-anchor allowing the release of soluble protein into the media, and the presence of PH20 in the resulting media and cells was determined by Western blot analysis.

A. Western Blot Analysis

Non-reduced samples were run on a 4-20% Tris-Glycine gel and transferred to PVDF membrane using iBlot (Invitrogen). For the Western blot, rabbit anti-PH20 IgG (0.5 µg/mL) was used as the primary antibody and HRP-conjugated goat anti-rabbit IgG (0.1 ng/mL, Cat#DC03L, EMD) was used as the secondary antibody. Evidence of expression is determined by a band at approximately 66 kDa, corresponding to recombinant human PH20 hyaluronidase.

B. PI-PLC Treatment

1. Transient Expression in 6-Well Plates

Following expression of rHuPH20 in CHO—S cells for 72 hours, as described in Example 2A above, the media and cells were harvested separately. The cells were washed with serum-free media followed by the addition of 2 mL serum-free media per well. PI-PLC (0.5 units/well) was added to each well and the cells were incubated in the PI-PLC for 2 hours. The resultant media and cells were analyzed by Western blot analysis as described above.

2. Transient Expression in 10 Cm Tissue Culture Dishes

Two plates each of rHuPH20 expressing CHO—S cells, one for treatment with PI-PLC and one without treatment with PI-PLC, were prepared for each C-terminus mutant as described in Example 2B above. Following expression for 48 hours, for cells untreated with PI-PLC, the media and cells were harvested separately. The harvested media was spun down, concentrated to a volume of 10 mL, and buffer exchanged into PBS using an Amicon 30 kD MWCO concentrator. The cells were rinsed with cold PBS and scraped and resuspended in 1.2 mL PBS with protease inhibitor Set III (Cat No. 539134, Calbiochem). The resuspended cells were briefly sonicated to prepare whole-cell extract. For PI-PLC treatment of cells, following expression for 48 hours, the untreated media was harvested, as described above. The cells were rinsed once with fresh CD DG44 medium with Glutamax-1, and the media was replaced with 12 mL fresh detergent free CD DG44 medium supplemented with Glutamax-1 with 3.0 units PI-PLC per dish, and the cells were incubated for 2 hours at 37° C. with 5% $CO_2$. After 2 hours, the PI-PLC media and cells were harvested separately, as described above. The resultant untreated media and cells, and PI-PLC treated media and cells, were analyzed by Western blot analysis as described above.

C. Results

The results are described in Table 4 below. Four mutants, ILFL (SEQ ID NO:58), SILF (SEQ ID NO:100), VSIL (SEQ ID NO:59) and IVSI (SEQ ID NO:101), exhibited low expression of PH20. Western blot analysis shows that human PH20 hyaluronidase carboxy-terminus deletion mutants shorter than F500 (SEQ ID NOS:59-95 and 100-101) are expressed in the media, as evidenced by a protein band at approximately 66 kDa. Human PH20 hyaluronidase carboxy-terminus deletion mutants with lengths between L501 and A507 (SEQ ID NOS:55-58 and 99) are expressed in the cells. Upon treatment of these cells with PI-PLC, human PH20 hyaluronidase is released into the media, as evidenced by a protein band at approximately 66 kDa. Treatment of cells from human PH20 hyaluronidase carboxy-terminus deletion mutants, corresponding to SEQ ID NOS:59-65 and 100-101, with PI-PLC had no effect since these proteins were initially expressed into the media.

TABLE 4

Human PH20 hyaluronidase carboxy-terminus deletion mutant expression.

| Mutant | Mature (AA) | Protein Expression | Expressed in Media | Expressed in Media Following Addition of PI-PLC |
|---|---|---|---|---|
| SPAM1-VASL (SEQ ID NO: 108) | 474 | YES | NO | YES |
| SPAM1-SSVA (SEQ ID NO: 55) | 472 | YES | NO | YES |
| SPAM1-IISS (SEQ ID NO: 56) | 470 | YES | NO | YES |
| SPAM1-FLII (SEQ ID NO: 57) | 468 | YES | NO | YES |
| SPAM1-LFLI (SEQ ID NO: 99) | 467 | YES | NO | YES |
| SPAM1-ILFL (SEQ ID NO: 58) | 466 | WEAK | NO | YES |
| SPAM1-SILF (SEQ ID NO: 100) | 465 | WEAK | WEAK/YES | Initially in media |
| SPAM1-VSIL (SEQ ID NO: 59) | 464 | WEAK | YES | Initially in media |
| SPAM1-IVSI (SEQ ID NO: 101) | 463 | WEAK | YES | Initially in media |
| SPAM1-FIVS (SEQ ID NO: 60) | 462 | YES | YES | Initially in media |
| SPAM1-TMFI (SEQ ID NO: 61) | 460 | YES | YES | Initially in media |
| SPAM1-SATM (SEQ ID NO: 62) | 458 | YES | YES | Initially in media |
| SPAM1-TLSA (SEQ ID NO: 63) | 456 | YES | YES | Initially in media |
| SPAM1-STLS (SEQ ID NO: 65) | 455 | YES | YES | Initially in media |
| SPAM1-PSTL (SEQ ID NO: 64) | 454 | YES | YES | Initially in media |
| SPAM1-ASPS (SEQ ID NO: 66) | 452 | YES | YES | n/a |
| SPAM1-YNAS (SEQ ID NO: 67) | 450 | YES | YES | n/a |
| SPAM1-FYNA (SEQ ID NO: 68) | 449 | YES | YES | n/a |
| SPAM1-IFYN (SEQ ID NO: 69) | 448 | YES | YES | n/a |
| SPAM1-QIFY (SEQ ID NO: 70) | 447 | YES | YES | n/a |
| SPAM1-PQIF (SEQ ID NO: 71) | 446 | YES | YES | n/a |
| SPAM1-EPQI (SEQ ID NO: 72) | 445 | YES | YES | n/a |
| SPAM1-EEPQ (SEQ ID NO: 73) | 444 | YES | YES | n/a |
| SPAM1-TEEP (SEQ ID NO: 74) | 443 | YES | YES | n/a |

TABLE 4-continued

Human PH20 hyaluronidase carboxy-terminus deletion mutant expression.

| Mutant | Mature (AA) | Protein Expression | Expressed in Media | Expressed in Media Following Addition of PI-PLC |
|---|---|---|---|---|
| SPAM1-ETEE (SEQ ID NO: 75) | 442 | YES | YES | n/a |
| SPAM1-METE (SEQ ID NO: 76) | 441 | YES | YES | n/a |
| SPAM1-PMET (SEQ ID NO: 77) | 440 | YES | YES | n/a |
| SPAM1-PPME (SEQ ID NO: 78) | 439 | YES | YES | n/a |
| SPAM1-KPPM (SEQ ID NO: 79) | 438 | YES | YES | n/a |
| SPAM1-LKPP (SEQ ID NO: 80) | 437 | YES | YES | n/a |
| SPAM1-FLKP (SEQ ID NO: 81) | 436 | YES | YES | n/a |
| SPAM1-AFLK (SEQ ID NO: 82) | 435 | YES | YES | n/a |
| SPAM1-DAFL (SEQ ID NO: 83) | 434 | YES | YES | n/a |
| SPAM1-IDAF (SEQ ID NO: 84) | 433 | YES | YES | n/a |
| SPAM1-CIDA (SEQ ID NO: 85) | 432 | YES | YES | n/a |
| SPAM1-VCID (SEQ ID NO: 86) | 431 | YES | YES | n/a |
| SPAM1-GVCI (SEQ ID NO: 87) | 430 | YES | YES | n/a |
| SPAM1-DGVC (SEQ ID NO: 88) | 429 | YES | YES | n/a |
| SPAM1-IADG (SEQ ID NO: 89) | 427 | YES | YES | n/a |
| SPAM1-VCIA (SEQ ID NO: 90) | 425 | YES | YES | n/a |
| SPAM1-VDVC (SEQ ID NO: 91) | 423 | YES | YES | n/a |
| SPAM1-DAVD (SEQ ID NO: 92) | 421 | YES | YES | n/a |
| SPAM1-DTDA (SEQ ID NO: 93) | 419 | YES | YES | n/a |
| SPAM1-VKDT (SEQ ID NO: 94) | 417 | YES | YES | n/a |
| SPAM1-ADVK (SEQ ID NO: 95) | 415 | YES | YES | n/a |

Example 4

Solubility of Human PH20 Hyaluronidase Carboxy-Terminus Deletion Mutants Using Triton® X-114 Assay In this example, the solubility of the human PH20 hyaluronidase carboxy-terminus deletion mutants was tested using a Triton® X-114 assay. In this assay, soluble PH20 hyaluronidases will partition into the aqueous phase of a Triton® X-114 solution warmed to 37° C. (modification as described by Bordier et al., (1981) *J. Biol. Chem.*, 256:1604-7) while membrane-anchored PH20 hyaluronidases will partition into the detergent rich phase.

For this purpose, 2% (v/v) Triton® X-114 in PBS at 0° C. was added to 200 μL of tissue culture media or cell extract, as prepared in Example 3B above, and the samples were incubated on ice. For separation, the sample was overlaid on a 30 μL sucrose cushion (6% w/v) containing 0.06% Triton® X-114 at 4° C. in a microfuge tube. The samples were heated to 37° C. for 3 minutes to induce phase separation and centrifuged for 3 min at 4000 g at room temperature. Aqueous and detergent phases were removed for SDS-PAGE analysis and Western blotting. Rabbit anti-PH20 IgG (0.5 μg/mL) was used as the primary antibody and HRP-conjugated goat anti-Rabbit IgG (0.1 ng/mL, Cat#DC03L, EMD) was used as the secondary antibody. Full length human PH20, which partitions strongly into the detergent phase, was used as a control.

The results of the solubility of the carboxy-terminus deletion mutants are shown in Table 5. Human PH20 hyaluronidase carboxy-terminus deletion mutants up to F500 (precursor SEQ ID NOS:7-13 and 48-49 or mature SEQ ID NOS: 59-65 and 100-101) partition into the aqueous phase and are therefore soluble. Human PH20 hyaluronidase carboxy-terminus deletion mutants longer than F500 (SEQ ID NOS:55-58 and 99) partition into the detergent phase and are insoluble. Full length PH20 is also insoluble.

TABLE 5

Solubility of human PH20 hyaluronidase carboxy-terminus deletion mutants

| Mutant | SEQ ID NO | Mature (AA) | Soluble |
|---|---|---|---|
| SPAM1-VASL | 108 | 474 | NO |
| SPAM1-SSVA | 55 | 472 | NO |
| SPAM1-IISS | 56 | 470 | NO |
| SPAM1-FLII | 57 | 468 | NO |
| SPAM1-LFLI | 99 | 467 | NO |
| SPAM1-ILFL | 58 | 466 | NO |
| SPAM1-SILF | 100 | 465 | YES |
| SPAM1-VSIL | 59 | 464 | YES |
| SPAM1-IVSI | 101 | 463 | YES |
| SPAM1-FIVS | 60 | 462 | YES |
| SPAM1-TMFI | 61 | 460 | YES |
| SPAM1-SATM | 62 | 458 | YES |
| SPAM1-TLSA | 63 | 456 | YES |
| SPAM1-PSTL | 64 | 454 | YES |
| SPAM1-STLS | 65 | 455 | YES |

Example 5

Hyaluronidase Activity of Human PH20 Hyaluronidase Carboxy-Terminus Deletion Mutants In this example, the human PH20 hyaluronidase carboxy-terminus deletion mutants were tested for their PH20 hyaluronidase activity using a microtiter assay with biotinylated-hyaluronic acid (biotinylated-HA or bHA). The human PH20 hyaluronidase carboxy-terminus deletion mutants were tested for hyaluronidase activity at both pH 7.4 and pH 5.5.

In short, a 4×BHX 96-well plate was coated with biotinylated-HA (1.1 MDa). The 72 hour post transfection supernatant from cells transfected with human PH20 hyaluronidase carboxy-terminus deletion mutants was diluted in buffer at either pH 7.4 or pH 5.5 and added to individual wells of the plate and allowed to incubate at 37° C. for 90 minutes. The reaction was terminated by addition of 4M guanidine HCl. The wells were washed 4× with Phosphate Buffered Saline with Tween20 (PBST) to remove any digested biotinylated-HA followed by addition of streptavidin-HRP for 1 hour at room temperature. The wells were washed 4× with PBST and the plate was developed with TMB. The plate was read at 450 nm using an ELISA plate reader. Hyaluronidase activity (in Units/mL) was determined by interpolating the measured absorbance at 450 nm with a hyaluronidase reference standard curve. Full length mature human PH20 hyaluronidase and untransfected CHO cells were used as positive and negative controls.

The results are shown in Tables 6 and 6A, below. Human PH20 hyaluronidase carboxy-terminus deletion mutants shorter than I430, corresponding to SPAM1-GDVC to SPAM1-ADVK (SEQ ID NOS:88-95), are inactive. Human PH20 hyaluronidase carboxy-terminus deletion mutants ending at I498 (SEQ ID NO:101), L499 (SEQ ID NO:59), F500 (SEQ ID NO:100), L501 (SEQ ID NO:58) and I502 (SEQ ID NO:99) have little detectable activity due to low expression level. All other human PH20 hyaluronidase carboxy-terminus deletion mutants (SEQ ID NOS:55-57 and 60-87) are active hyaluronidases at both pH 7.4 and pH 5.5.

TABLE 6

| Deletion Mutant | Precursor (AA) | Mature (AA) | pH 7.4 Activity (Units/ml) | pH 5.5 Activity (Units/ml) |
|---|---|---|---|---|
| SPAM1-SSVA (SEQ ID NO: 55) | 507 | 472 | 1.4715 | 1.125 |
| SPAM1-IISS (SEQ ID NO: 56) | 505 | 470 | 1.458 | 0.837 |
| SPAM1-FLII (SEQID NO: 57) | 503 | 468 | 0.9405 | 0.6345 |
| SPAM1-ILFL (SEQ ID NO: 58) | 501 | 466 | 0.0405 | 0.0405 |
| SPAM1-VSIL (SEQ ID NO: 59) | 499 | 464 | 0.02025 | 0.045 |
| SPAM1-FIVS (SEQ ID NO: 60) | 497 | 462 | 0.1755 | 0.216 |
| SPAM1-TMFI (SEQ ID NO: 61) | 495 | 460 | 0.45 | 0.612 |
| SPAM1-SATM (SEQ ID NO: 62) | 493 | 458 | 0.5715 | 0.7335 |
| SPAM1-TLSA (SEQ ID NO: 63) | 491 | 456 | 0.3645 | 0.5625 |
| SPAM1-STLS (SEQ ID NO: 65) | 490 | 455 | 0.819 | 1.2375 |
| SPAM1-PSTL (SEQ ID NO: 64) | 489 | 454 | 1.557 | 1.089 |
| SPAM1-ASPS (SEQ ID NO: 66) | 487 | 452 | 1.017 | 0.9225 |
| SPAM1-YNAS (SEQ ID NO: 67) | 485 | 450 | 1.8765 | 1.74825 |
| SPAM1-FYNA (SEQ ID NO: 68) | 484 | 449 | 1.4985 | 1.26225 |
| SPAM1-IFYN (SEQ ID NO: 69) | 483 | 448 | 2.45025 | 2.3085 |
| SPAM1-QIFY (SEQ ID NO: 70) | 482 | 447 | 2.03175 | 1.647 |
| SPAM1-PQIF (SEQ ID NO: 71) | 481 | 446 | 1.818 | 1.701 |
| SPAM1-EPQI (SEQ ID NO: 72) | 480 | 445 | 2.1825 | 1.6425 |
| SPAM1-EEPQ (SEQ ID NO: 73) | 479 | 444 | 1.917 | 2.0745 |
| SPAM1-TEEP (SEQ ID NO: 74) | 478 | 443 | 1.764 | 1.584 |
| SPAM1-ETEE (SEQ ID NO: 75) | 477 | 442 | 2.088 | 2.0475 |
| SPAM1-METE (SEQ ID NO: 76) | 476 | 441 | 1.332 | 1.278 |
| SPAM1-PMET (SEQ ID NO: 77) | 475 | 440 | 2.223 | 2.0925 |
| SPAM1-PPME (SEQ ID NO: 78) | 474 | 439 | 1.2105 | 1.341 |
| SPAM1-KPPM (SEQ ID NO: 79) | 473 | 438 | 0.8595 | 0.91575 |

TABLE 6-continued

Hyaluronidase Activity

| Deletion Mutant | Precursor (AA) | Mature (AA) | pH 7.4 Activity (Units/ml) | pH 5.5 Activity (Units/ml) |
|---|---|---|---|---|
| SPAM1-LKPP (SEQ ID NO: 80) | 472 | 437 | 0.5445 | 0.9 |
| SPAM1-FLKP (SEQ ID NO: 81) | 471 | 436 | 3.321 | 2.79 |
| SPAM1-AFLK (SEQ ID NO: 82) | 470 | 435 | 3.204 | 2.925 |
| SPAM1-DAFL (SEQ ID NO: 83) | 469 | 434 | 2.3895 | 2.2365 |
| SPAM1-IDAF (SEQ ID NO: 84) | 468 | 433 | 0.5625 | 0.62775 |
| SPAM1-CIDA (SEQ ID NO: 85) | 467 | 432 | 0.5535 | 0.4725 |
| SPAM1-VCID (SEQ ID NO: 86) | 466 | 431 | 0 | 0.2115 |
| SPAM1-GVCI (SEQ ID NO: 87) | 465 | 430 | 0.441 | 0.468 |
| SPAM1-DGVC (SEQ ID NO: 88) | 464 | 429 | 0 | 0.045 |
| SPAM1-IADG (SEQ ID NO: 89) | 462 | 427 | 0 | 0.00225 |
| SPAM1-VCIA (SEQ ID NO: 90) | 460 | 425 | 0 | 0.0135 |
| SPAM1-VDVC (SEQ ID NO: 91) | 458 | 423 | 0.0495 | 0.0585 |
| SPAM1-DAVD (SEQ ID NO: 92) | 456 | 421 | 0 | 0.0675 |
| SPAM1-DTDA (SEQ ID NO: 93) | 454 | 419 | 0 | 0.054 |
| SPAM1-VKDT (SEQ ID NO: 94) | 452 | 417 | 0.054 | 0.0225 |
| SPAM1-ADVK (SEQ ID NO: 95) | 450 | 415 | 0.063 | 0.0405 |
| VASL (SEQ ID NO: 108) | 509 | 474 | 1.8045 | 0.891 |
| VASL + PLC (SEQ ID NO: 108) | 509 | 474 | 3.96 | 2.313 |
| HZ24-PH20 (SEQ ID NO: 109) | 482 | 447 | 0.499 | 0.726188 |
| CHO-S | n/a | n/a | 0 | 0.012375 |

TABLE 6A

Hyaluronidase Activity

| Deletion Mutant | Precursor (AA) | Mature (AA) | pH 7.4 Activity (Units/ml) | pH 5.5 Activity (Units/ml) |
|---|---|---|---|---|
| SPAM1-SSVA (SEQ ID NO: 55) | 507 | 472 | 1.782 | 1.256 |

TABLE 6A-continued

Hyaluronidase Activity

| Deletion Mutant | Precursor (AA) | Mature (AA) | pH 7.4 Activity (Units/ml) | pH 5.5 Activity (Units/ml) |
|---|---|---|---|---|
| SPAM1-IISS (SEQ ID NO: 56) | 505 | 470 | 1.863 | 0.932 |
| SPAM1-FLII (SEQ ID NO: 57) | 503 | 468 | 1.094 | 0.648 |
| SPAM1-LFLI (SEQ ID NO: 99) | 502 | 467 | 0.608 | 0.324 |
| SPAM1-ILFL (SEQ ID NO: 58) | 501 | 466 | 0.446 | 0.122 |
| SPAM1-SILF (SEQ ID NO: 100) | 500 | 465 | 0.365 | 0.162 |
| SPAM1-VSIL (SEQ ID NO: 59) | 499 | 464 | 0.486 | 0.122 |
| SPAM1-IVSI (SEQ ID NO: 101) | 498 | 463 | 0.527 | 0.203 |
| SPAM1-FIVS (SEQ ID NO: 60) | 497 | 462 | 0.365 | 0.162 |
| SPAM1-TMFI (SEQ ID NO: 61) | 495 | 460 | 0.689 | 0.770 |
| SPAM1-SATM (SEQ ID NO: 62) | 493 | 458 | 0.689 | 0.851 |
| SPAM1-TLSA (SEQ ID NO: 63) | 491 | 456 | 0.851 | 0.729 |
| SPAM1-PSTL (SEQ ID NO: 64) | 489 | 454 | 1.985 | 3.321 |
| SPAM1-ASPS (SEQ ID NO: 66) | 487 | 452 | 1.134 | 1.580 |

Example 6

Glycan Analysis of rHuPH20 by LC-MS

In this example, a glycan analysis study of rHuPH20 (SEQ ID NO:122) was performed by mass spectral analysis of trypsin digested PH20.

Briefly, rHuPH20 (as produced in Example 15C), was lyophilized and resuspended in buffer containing 6M guanidine HCL, 0.002 M EDTA and 0.02 M Tris, pH 8.28 to a final concentration of 0.5 mg/mL. DTT (10 mM final concentration) was added and the protein/DTT mixture was incubated for 1 hour at 37° C. Following reduction, iodoacetamide was added to a final concentration of 20 mM. Finally, trypsin (1:25 w/w) was added and the mixture was incubated for 20 hours at 37° C.

The tryptic digests were analyzed by LC-MS. Briefly, the tryptic digests were injected onto a C18 reverse phase column using the conditions set forth in Table 7 below. MS data was collected on a Q-TOF Ultima mass spectrometer using electrospray ionization (ESI) in positive ion mode. Data was acquired from m/z 200-1950 in MS mode. The glycopeptides were analyzed using GlycoMod software (www.expasy.ch/tools/glycomod/) to determine the glycan type.

TABLE 7

LC-MS parameters and settings

| Parameter | Setting | | |
|---|---|---|---|
| Column | Phenomenex Synergi Hydro-RP | | |
| Column Temperature | 30° C. | | |
| Mobile Phase A | Deionized water containing 0.2% formic acid | | |
| Mobile Phase B | Acetonitrile containing 0.2% formic acid | | |
| | Time (min) | % A | % B |
| Gradient | 0.0 | 97.0 | 3.0 |
| | 5.0 | 97.0 | 3.0 |
| | 144.0 | 60.0 | 40.0 |
| | 150.0 | 10.0 | 90.0 |
| | 160.0 | 10.0 | 90.0 |
| | 161.0 | 97.0 | 3.0 |
| | 180.0 | 97.0 | 3.0 |
| Flow Rate | 0.2 mL/min | | |
| Injection Volume | 5 µL | | |
| Run Time (total) | 180 minutes | | |

Human PH20 hyaluronidase has one O-glycosylation site at T475. The site is occupied by a core type 1 glycan that has one or two sialic acids. rHuPH20 is glycosylated at six different asparagine residues, including N82, N166, N235, N254, N368, and N393. The results show that N254 is approximately 75% occupied, N393 is approximately 85% occupied, and the four remaining sites, N82, N166, N235 and N368, are greater than 99% occupied. All of the three types of N-glycans, high mannose, hybrid and complex types, are present in rHuPH20. In general, rHuPH20 contains about 45% high mannose glycans, 45% complex glycans and 10% hybrid glycans. About 35% of the total glycans are anionic, of which 25% contain a sialic acid and the remaining 10% contain an unknown anionic group, possibly a phosphate group. Most of the complex glycans are fucosylated and the anionic complex glycans contain mostly one sialic acid while a few of them contain two sialic acids. Each asparagine residue has about 90% of one type of glycan and a small proportion of the other two types of glycans, with the exception of N235. The major glycan type for each residue is set forth in Table 8 below. Residues N82, N166 and N254 are occupied by complex glycans. Residues N368 and N393 are occupied by high mannose glycans. Residue N235 is occupied by approximately 80% high mannose glycans, with approximately 20% complex glycans.

TABLE 8

Types of N-glycans at asparagine residues in rHuPH20

| Glycan Site | High Mannose glycans | Complex Glycans |
| --- | --- | --- |
| N82 | | X |
| N166 | | X |
| N235 | ~80% | ~20% |
| N254 | | X |
| N368 | X | |
| N393 | X | |

For complete deglycosylation, purified rHuPH20 (0.1 mg/mL final concentration) was incubated with PNGaseF (50,000 units/mL) in 50 mM phosphate buffer pH 7.2 overnight at 37° C. For partial deglycosylation, purified rHuPH20 (0.5 mg/mL final concentration) was incubated with 0.3 units/mL of endoglycosidase (either EndoF1, EndoF2, EndoF3 or EndoH) or a mixture all four endoglycosidases in 50 mM sodium acetate buffer pH 5.0 overnight at 35° C. Deglycosylation of rHuPH20 was analyzed by the shift in the mobility of PH20 by SDS-PAGE. Hyaluronidase enzymatic activity was determined as described in Example 5.

Human PH20 hyaluronidase has a molecular weight of approximately 66 kDa. Treatment with EndoF1, EndoH or a mixture of EndoF1, EndoF2, EndoF3 and EndoH resulted in partially deglycosylated human PH20 hyaluronidase as determined by SDS-PAGE mobility shift to a molecular weight of approximately 56 kDa. Treatment with PNGaseF resulted in complete deglycosylation of human PH20 hyaluronidase. Partial deglycosylation of rHuPH20 did not result in inactivation of hyaluronidase enzymatic activity whereas exhaustive digestion with PNGaseF to completely remove N-glycans resulted in the total loss of hyaluronidase enzymatic activity (see Table 9 below).

TABLE 9

Effect of glycosidase treatment on rHuPH20 activity

| rHuPH20 (U/ml) | Control PH20 | EndoF1 | EndoF2 | EndoF3 | EndoH | EndoF1, F2, F3, H | PNGaseF |
| --- | --- | --- | --- | --- | --- | --- | --- |
| 1.0000 | 0.3195 | 0.2983 | 0.2573 | | 0.2965 | 0.2144 | 1.9315 |
| 0.2000 | 0.7910 | 0.7656 | 0.6048 | 0.5880 | 0.7435 | 0.5366 | 1.9173 |
| 0.0400 | 1.4299 | 1.3450 | 1.3117 | 1.2255 | 1.3584 | 1.3877 | 1.9926 |
| 0.0080 | 1.8397 | 1.7338 | 1.6900 | 1.6698 | 1.6998 | 1.8418 | 1.9172 |

Example 7

Deglycosylation of Human PH20 Hyaluronidase by Treatment with Endoglycosidases

In this example, human PH20 hyaluronidase was deglycosylated by treatment of purified rHuPH20 (SEQ ID NO:122) with various glycosidases and hyaluronidase activity was assessed. Human PH20 hyaluronidase is glycosylated at six different asparagine residues, including N82, N166, N235, N254, N368, and N393. Five glycosidases were used to generate deglycosylated human PH20 hyaluronidase, including: PNGaseF (New England Biolabs, Cat. No. P0704S, Lot #34), which cleaves all N-glycans; EndoF1, which cleaves high mannose and hybrid type glycans; EndoF2, which cleaves biantennary complex type glycans; EndoF3, which cleaves biantennary and more branched complex glycans; and EndoH (New England Biolabs, Cat. No. P0702S), which cleaves high mannose and hybrid type glycans. Therefore, treatment with PNGaseF results in complete deglycosylation whereas treatment with endoglycosidases results in only partial deglycosylation.

Example 8

Treatment of Human PH20 Hyaluronidase with Glycosylation Inhibitors

In this example, rHuPH20 (SEQ ID NO:122) was transiently expressed in the presence of each of two glycosylation inhibitors and hyaluronidase secretion and activity were assessed. Kifunensine is a potent inhibitor mannosidase I, an enzyme involved in glycan processing (see e.g., Elbein et al., J Biol Chem, 265:15599-15605 (1990)). Tunicamycin is a mixture of homologous nucleoside antibiotics that inhibit the enzyme GlcNAc phospho-transferase (GPT), thereby blocking the synthesis of all N-glycans (see e.g., Böhme et al., Eur. J. Biochem. 269:977-988 (2002)).

Briefly, 1×10$^6$ HZ24-2B2 cells expressing rHuPH20 (see Example 14 below) were seeded in 24 mL complete CD-CHO medium in two 125 mL flasks. Tunicamycin (dissolved in DMSO) or Kifunensine (freshly dissolved in water) was added to a final concentration of 5 μg/mL (containing 12 μL DMSO). As a control, one flask was seeded with 1×10$^6$ HZ24-2B2 cells expressing rHuPH20 and 12 μL DMSO was added as a vehicle control. Following addition of either tunicamycin or kifunensine, the cells were incubated for 4-6 hours at 37° C. with 5% CO$_2$. Following expression, a 2 mL culture was removed and centrifuged for 5 minutes at 500 g. The supernatant was stored at 4° C. and the cell pellets were stored at −20° C. The remaining 22 mL cultures were centrifuged for 5 minutes at 500 g. The supernatant was stored at 4° C. The cells were resuspended in 22 mL complete CD-CHO medium in the original two 125 mL flasks. Tunicamycin or Kifunensine was added to the culture at a final concentration of 5 μg/mL and the cells were incubated at 37° C. with 5% $CO_2$. Two mL (2 mL) cultures were removed from each flask at approximately every 24 hours post changing medium. For each time point, the supernatant was stored at 4° C. and the cell pellets were stored at −20° C. The expression of rHuPH20 was analyzed by Western blot analysis and the hyaluronidase activity was measured using the biotinylated HA enzymatic assay (as described in Examples 3 and 5 above).

The results are shown in Tables 10-13 below, which set forth the number of viable cells and the PH20 activity. As shown in Tables 10-11, tunicamycin inhibits PH20 activity in both tissue culture media and inside the cell and also results in a complete loss of cell viability. Additionally, one hour of treatment with tunicamycin resulted in the accumulation of deglycosylated human PH20 hyaluronidase inside the cell, as determined by SDS-PAGE mobility shift to a molecular weight of approximately 56 kDa in the cell pellet fractions. As shown in Tables 12-13, kifunensine did not affect the activity of PH20 while western blot analysis revealed kifunensine inhibited the expression and secretion of rHuPH20 in treated cells.

TABLE 10

Effect of Tunicamycin on Cell Viability and PH20 activity in Tissue Culture Media

| Time (hours) | With Tunicamycin | | Without Tunicamycin | |
|---|---|---|---|---|
| | Viable Cells ($\times 10^6$) | PH20 activity (U/mL) | Viable Cells ($\times 10^6$) | PH20 activity (U/mL) |
| 0 | 1.04 | 0.50 | 1.04 | 0.00 |
| 1 | 1.04 | 2.80 | 1.04 | 1.50 |
| 2 | 1.04 | 5.00 | 1.04 | 3.00 |
| 4 | 0.910 | 8.80 | 1.30 | 7.00 |
| 25 | 1.08 | 5.80 | 1.32 | 82.50 |
| 49 | 0.200 | 6.80 | 2.72 | 171.30 |
| 73 | 0.080 | 7.80 | 3.80 | 331.00 |
| 91 | 0 | 7.50 | 6.25 | 313.30 |

TABLE 11

Effect of Tunicamycin on Cell Viability and PH20 activity in Cell Pellets

| Time (hours) | With Tunicamycin | | Without Tunicamycin | |
|---|---|---|---|---|
| | Viable Cells ($\times 10^6$) | PH20 activity (U/mL) | Viable Cells ($\times 10^6$) | PH20 activity (U/mL) |
| 0 | 1.04 | 34.50 | 1.04 | 35.00 |
| 1 | 1.04 | 38.00 | 1.04 | 38.10 |
| 2 | 1.04 | 34.00 | 1.04 | 36.60 |
| 4 | 0.910 | 18.00 | 1.30 | 31.90 |
| 25 | 1.08 | 1.00 | 1.32 | 14.40 |
| 49 | 0.200 | 0.80 | 2.72 | 33.10 |
| 73 | 0.080 | 0.30 | 3.80 | 67.50 |
| 91 | 0 | 0.30 | 6.25 | 79.40 |

TABLE 12

Effect of Kifunensine on Cell Viability and PH20 activity in Tissue Culture Media

| Time (hours) | With Kifunensine | | Without Kifunensine | |
|---|---|---|---|---|
| | Viable Cells ($\times 10^6$) | PH20 activity (U/mL) | Viable Cells ($\times 10^6$) | PH20 activity (U/mL) |
| 0 | 1 | 0.4 | 1 | 0.45 |
| 6 | 1 | 23.85 | 1 | 15.75 |
| 24 | 1.2 | 129.6 | 1.4 | 75.6 |
| 50 | 2.1 | 299.7 | 2.4 | 206.55 |
| 72 | 3 | 535.95 | 4.4 | 444.15 |
| 96 | 3.7 | 945 | 6.3 | 726.3 |
| 144 | 5.8 | 2968.65 | 8.5 | 2241 |

TABLE 13

Effect of Kifunensine on Cell Viability and PH20 activity in Cell Pellets

| Time (hours) | With Kifunensine | | Without Kifunensine | |
|---|---|---|---|---|
| | Viable Cells ($\times 10^6$) | PH20 activity (U/mL) | Viable Cells ($\times 10^6$) | PH20 activity (U/mL) |
| 0 | 1 | 22.25 | 1 | 23 |
| 6 | 1 | 21.25 | 1 | 27 |
| 24 | 1.2 | 27.75 | 1.4 | 14.45 |
| 50 | 2.1 | 43 | 2.4 | 26 |
| 72 | 3 | 98.75 | 4.4 | 52.75 |
| 96 | 3.7 | 208.75 | 6.3 | 167.5 |
| 144 | 5.8 | 497.25 | 8.5 | 107 |

Example 9

Transient Expression of rHuPH20 in Lectin Resistant CHO Mutants

In this example, rHuPH20 was transiently expressed in four Lectin resistant CHO mutants and hyaluronidase secretion and activity were assessed. The Lectin resistant CHO mutants are summarized in Table 14 below. Pro⁻5 cells lack the galactosyltransferase β4galT-6 causing a reduction in galactosylated N-glycans (see, e.g., Lee et al. *J. Biol. Chem.* 276:13924-13934 (2001)). Lec1 cells lack N-acetylglucosaminyltranferase I activity and therefore do not synthesize complex or hybrid glycans (see, e.g., Chen and Stanley, *Glycobiology*, 13:43-50 (2003)). Lec2 and Lec8 are deficient in nucleotide-sugar transporters, which transport nucleotide-sugars across the ER or golgi membrane. Lec2 cells are unable to translocate CMP-sialic acid (namely CMP-NeuAc) therefore causing the expression of asialo cell surfaces (see, e.g., Eckhardt et al., *J. Biol. Chem.* 273:20189-20195 (1998)). Lec8 cells are unable to translocate UDP-galactose therefore causing glycans devoid of galactose (see, e.g., Bakker et al., *Glycobiology*, 15:193-201 (2005)).

TABLE 14

Lectin resistant CHO mutants

| CHO line | Biochemical Change | Genetic Change |
|---|---|---|
| Pro⁻5 (parent) | ↓ Gal on N-glycans | No expression of β4galt6 |
| Lec1 | ↓ GlcNAc-TI | Insertion/deletion in Mgat1 ORF |

TABLE 14-continued

Lectin resistant CHO mutants

| CHO line | Biochemical Change | Genetic Change |
|---|---|---|
| Lec2 | ↓ CMP-sialic acid Golgi transporter | Mutation in Slc35a1 ORF |
| Lec8 | ↓ UDP-Gal Golgi transporter | Mutation in Slc35a2 ORF |

In brief, PH20sHis (encoding his-tagged PH20, SEQ ID NO:187) was transiently expressed in each of four strains of lectin resistant CHO mutants, including Lec1 (Cat No. CRL-1735, ATCC), Lec2 (Cat No. CRL-1736, ATCC), Lec8 (Cat No. CRL-1737, ATCC) and Pro⁻5 (Cat No. CRL-1781) as described in Example 2A above. Additionally, HZ24-mut(B/S) (encoding PH20 truncated at amino acid 482, SEQ ID NO:122) was transiently expressed in Pro⁻5 cells and as negative control, Pro⁻5 cells were subjected to a mock transfection. The resulting cell culture media was analyzed by Western blot analysis and hyaluronidase activity was measured using the biotinylated HA enzymatic assay (as described in Examples 3 and 5 above).

The results show that rHuPH20 expressed in the Lec mutants is secreted into the medium, as evidenced by a protein band at approximately 66 kDa. The results of the bHA enzymatic assay are set forth in Table 15 below, which sets for the lectin resistant CHO mutant, the PH20 encoding plasmid used to transfect the cells, and the PH20 activity at pH5.5 for both a 1:27 and 1:81 dilution. rHuPH20 expressed by Lec mutant cells is enzymatically active.

TABLE 15

PH20 activity (U/mL) of rHuPH20 transiently expressed in Lec mutant cells.

| | Lectin Mutant | | | | | |
|---|---|---|---|---|---|---|
| Plasmid | Pro-5 HZ24-mut(B/S) | Pro-5 HZ24-PH20sHis | Lec1 HZ24-PH20sHis | Lec2 HZ24-PH20sHis | Lec8 HZ24-PH20sHis | Pro-5 Mock transfection |
| PH20 Activity (1:27) | 0.6615 | 0.297 | 0.54 | 0.675 | 0.2565 | 0.081 |
| PH20 Activity (1:81) | 1.1745 | 0.6075 | 0.7695 | 1.053 | 0.567 | 0.1215 |

Example 10 ite-Directed Mutagenesis of Human PH20 Hyaluronidase N-Glycosylation Sites

In this example, N-glycan site specific human PH20 hyaluronidase deglycosylation mutants were generated and their secretion patterns and hyaluronidase enzymatic activity were assessed. The N-glycan site specific deglycosylation mutants and glycan types are set forth in Table 16 below.

PH20sHis (SEQ ID NO:210) was used as a template for mutagenesis of each asparagine residue to alanine using QuikChange® Site-Directed Mutagenesis Kit (Cat No. 200518, Stratagene). The protein encoded by the template DNA corresponds to PH20sHis (SEQ ID NO:187), a human PH20 clone that contains a HexaHis tag (SEQ ID NO:142) after amino acid 5490. Wild type PH20sHis and deglycosylated mutants are set forth in Table 16. Six single mutants were generated, one for each of the N-glycosylation sites. Additionally, three double mutants and a triple mutant were generated for asparagines N82, N166 and N254, all of which are occupied by complex type glycans. Finally, a double mutant N368A/N393A was generated, lacking high mannose glycans. The mutants were transfected into CHO—S cells and expression was performed as described in Example 2A. Secretion into the media and hyaluronidase activity were determined as described in Examples 3 and 5, above.

The results are shown in Table 16 below, which sets forth the mutation, the glycan types, whether the protein was secreted into the media and the hyaluronidase activity at both pH 5.5 and pH 7.4. Western blot analysis showed that mutation of residues N82, N166, N235 and N254 had no effect on secretion of the rHuPH20 protein into the media. Alternatively, mutation of residues N368A and N368A/N393A prevented PH20 expression and secretion, as evidenced by a lack of protein at approximately 66 kDa in the media. Mutation of residue N393A resulted in reduced protein expression, but rHuPH20 was observed in the media, as evidenced by a protein band at approximately 66 kDa. Mutation of a residues N82, N166 and/or N254 had no effect on rHuPH20 activity. These residues are occupied by complex glycans. In contrast, mutation of residues N235, N368 and/or N393, which contain high mannose glycans, resulted in a complete loss of detectable activity in the media due to a lack of secretion.

TABLE 16

Human PH20 Hyaluronidase Deglycosylation Mutants

| Mutant | SEQ ID NO | Glycan Type | Secretion | Activity pH 5.5 | Activity pH 7.4 |
|---|---|---|---|---|---|
| PH20sHis (parent) | 187 | Both | YES | YES | YES |
| N82A | 202 | Complex | YES | YES | YES |
| N166A | 203 | Complex | YES | YES | YES |
| N235A | 204 | High Mannose (80%) Complex (20%) | YES | NO | NO |
| N254A | 205 | Complex | YES | YES | YES |
| N368A | 188 | High Mannose | NO | NO | NO |
| N393A | 189 | High Mannose | YES (WEAK) | NO | NO |
| N82A/N166A | 206 | Complex | YES | YES | YES |
| N82A/N254A | 207 | Complex | YES | YES | YES |
| N166A/N254A | 208 | Complex | YES | YES | YES |

TABLE 16-continued

Human PH20 Hyaluronidase Deglycosylation Mutants

| Mutant | SEQ ID NO | Glycan Type | Secretion | Activity pH 5.5 | Activity pH 7.4 |
|---|---|---|---|---|---|
| N82A/N166A/N254A | 209 | Complex | YES | YES | YES |
| N368A/N393A | 190 | High Mannose | NO | NO | NO |

Immunofluorescent analysis of CHO cells with an anti-PH20 antibody was used to visualize the expression of the N-glycan site specific deglycosylation mutants N368A, N393A and N368A/N393A. CHO cells were seeded for monolayer culture onto 8-well chamber slides with 200 μL of cells at $2.5 \times 10^4$ cells per ml of Dulbecco's Modified Eagle Medium (DMEM) containing 10% fetal bovine serum (FBS) and grown at 37° C. in a humidified atmosphere of 5% $CO_2$. Cells were transfected 36 hours later at 80% confluency using Lipofectamine™ 2000 (Invitrogen) as follows. DNA (0.4 μg in 50 μL of DMEM without serum) and Lipofectamine™ 2000 (1 μL in DMEM without serum) were mixed gently for 20 minutes at room temperature and then added to each well containing cells and 100 μL, serum free medium. Mixing was effected by gently rocking the plate back and forth. The cells were then incubated at 37° C. in a $CO_2$ incubator for 4-6 hours after which the medium was replaced with medium containing 10% FBS. At 48 hours post-transfection, the cells on the chamber slides were fixed with 4% paraformaldehyde for 15 minutes. The cells were washed 3× with PBS and 200 μL of a 1% NP-40/PBS solution was added and incubated for 30 minutes at room temperature. The cells were washed 3× with PBS and stored at 4° C. prior to immunolabeling.

To immunolabel the cells, the samples were blocked with 15% normal goat serum for 30 minutes at room temperature. The cells were incubated with a 1:20 solution of anti-PH20 rabbit IgG diluted in 5% normal goat serum in PBS for 2 hours. Finally, the cells were washed 3× with PBS followed by incubation with a FITC-conjugated goat anti-rabbit IgG for 1 hour followed by visualization. In addition, the mounting solution contained DAPI allowing for nuclei staining. Immunofluorescent analysis using the anti-PH20 antibody showed that N368A and N393A mutations caused PH20 to accumulate inside the cells.

Summary of N-Glycosylation Studies

As exhibited in Examples 7-10 above, N-linked glycosylation is essential for proper folding and enzymatic activity of rHuPH20. Complete deglycosylation of rHuPH20, effected by exhaustive digestion with PNGaseF or by inhibition of glycosylation during biosynthesis by treatment with tunicamyicn, abolished all detectable enzymatic activity. In addition, unglycosylated rHuPH20 was shown to accumulate in the cell. In contrast, partially deglycosylated rHuPH20, effected by treatment with kifunensine or by expression in Lec mutants, retained enzymatic activity. Finally, detailed mutational analysis using site-directed mutagenesis revealed that the presence of high mannose type glycans is necessary for production of soluble, enzymatically active rHuPH20.

Example 11

Generation of a Soluble rHuPH20-Expressing Cell Line

The HZ24 plasmid (set forth in SEQ ID NO:140) was used to transfect Chinese Hamster Ovary (CHO cells) (see e.g. U.S. patent application Ser. Nos. 10,795,095, 11/065,716 and 11/238,171). The HZ24 plasmid vector for expression of soluble rHuPH20 contains a pCI vector backbone (Promega), DNA encoding amino acids 1-482 of human PH20 hyaluronidase (SEQ ID NO:110), an internal ribosomal entry site (IRES) from the ECMV virus (Clontech), and the mouse dihydrofolate reductase (DHFR) gene. The pCI vector backbone also includes DNA encoding the Beta-lactamase resistance gene (AmpR), an f1 origin of replication, a Cytomegalovirus immediate-early enhancer/promoter region (CMV), a chimeric intron, and an SV40 late polyadenylation signal (SV40). The DNA encoding the soluble rHuPH20 construct contains an NheI site and a Kozak consensus sequence prior to the DNA encoding the methionine at amino acid position 1 of the native 35 amino acid signal sequence of human PH20, and a stop codon following the DNA encoding the tyrosine corresponding to amino acid position 482 of the human PH20 hyaluronidase set forth in SEQ ID NO:107, followed by a BamHI restriction site. The construct pCI-PH20-IRES-DHFR-SV40pa (HZ24), therefore, results in a single mRNA species driven by the CMV promoter that encodes amino acids 1-482 of human PH20 (set forth in SEQ ID NO:109 and amino acids 1-186 of mouse dihydrofolate reductase (set forth in SEQ ID NO:141), separated by the internal ribosomal entry site (IRES).

Non-transfected DG44 CHO cells growing in GIBCO Modified CD-CHO media for DHFR(−) cells, supplemented with 4 mM Glutamine and 18 ml/L Pluronic F68/L (Gibco), were seeded at $0.5 \times 10^6$ cells/ml in a shaker flask in preparation for transfection. Cells were grown at 37° C. in 5% $CO_2$ in a humidified incubator, shaking at 120 rpm. Exponentially growing non-transfected DG44 CHO cells were tested for viability prior to transfection.

Sixty million viable cells of the non-transfected DG44 CHO cell culture were pelleted and resuspended to a density of $2 \times 10^7$ cells in 0.7 mL of 2× transfection buffer (2×HeBS: 40 mM Hepes, pH 7.0, 274 mM NaCl, 10 mM KCl, 1.4 mM $Na_2HPO_4$, 12 mM dextrose). To each aliquot of resuspended cells, 0.09 mL (250 μg) of the linear HZ24 plasmid (linearized by overnight digestion with Cla I (New England Biolabs) was added, and the cell/DNA solutions were transferred into 0.4 cm gap BTX (Gentronics) electroporation cuvettes at room temperature. A negative control electroporation was performed with no plasmid DNA mixed with the cells. The cell/plasmid mixes were electroporated with a capacitor discharge of 330 V and 960 μF or at 350 V and 960 μF.

The cells were removed from the cuvettes after electroporation and transferred into 5 mL of Modified CD-CHO media for DHFR(−) cells, supplemented with 4 mM Glutamine and 18 ml/L Pluronic F68/L (Gibco), and allowed to grow in a well of a 6-well tissue culture plate without selection for 2 days at 37° C. in 5% $CO_2$ in a humidified incubator.

Two days post-electroporation, 0.5 mL of tissue culture media was removed from each well and tested for the presence of hyaluronidase activity, using the microturbidity assay described in Example 12. Results are shown in Table 17.

TABLE 17

Initial Hyaluronidase Activity of HZ24 Transfected DG44 CHO cells at 40 hours post-transfection

| | Dilution | Activity Units/ml |
|---|---|---|
| Transfection 1 330 V | 1 to 10 | 0.25 |
| Transfection 2 350 V | 1 to 10 | 0.52 |
| Negative Control | 1 to 10 | 0.015 |

Cells from Transfection 2 (350V) were collected from the tissue culture well, counted and diluted to $1\times10^4$ to $2\times10^4$ viable cells per mL. A 0.1 mL aliquot of the cell suspension was transferred to each well of five, 96 well round bottom tissue culture plates. One hundred microliters of CD-CHO media (GIBCO) containing 4 mM GlutaMAX™-1 supplement (GIBCO™, Invitrogen Corporation) and without hypoxanthine and thymidine supplements were added to the wells containing cells (final volume 0.2 mL).

Ten clones were identified from the 5 plates grown without methotrexate (Table 18).

TABLE 18

Hyaluronidase activity of identified clones

| Plate/Well ID | Relative Hyaluronidase |
|---|---|
| 1C3 | 261 |
| 2C2 | 261 |
| 3D3 | 261 |
| 3E5 | 243 |
| 3C6 | 174 |
| 2G8 | 103 |
| 1B9 | 304 |
| 2D9 | 273 |
| 4D10 | 302 |

Six HZ24 clones were expanded in culture and transferred into shaker flasks as single cell suspensions. Clones 3D3, 3E5, 2G8, 2D9, 1E11, and 4D10 were plated into 96-well round bottom tissue culture plates using a two-dimensional infinite dilution strategy in which cells were diluted 1:2 down the plate, and 1:3 across the plate, starting at 5000 cells in the top left hand well. Diluted clones were grown in a background of 500 non-transfected DG44 CHO cells per well, to provide necessary growth factors for the initial days in culture. Ten plates were made per subclone, with 5 plates containing 50 nM methotrexate and 5 plates without methotrexate.

Clone 3D3 produced 24 visual subclones (13 from the no methotrexate treatment, and 11 from the 50 nM methotrexate treatment. Significant hyaluronidase activity was measured in the supernatants from 8 of the 24 subclones (>50 Units/mL), and these 8 subclones were expanded into T-25 tissue culture flasks. Clones isolated from the methotrexate treatment protocol were expanded in the presence of 50 nM methotrexate. Clone 3D35M was further expanded in 500 nM methotrexate giving rise to clones producing in excess of 1,000 Units/ml in shaker flasks (clone 3D35M; or Gen1 3D35M). A master cell bank (MCB) of the 3D35M cells was then prepared.

Example 12

Determination of Hyaluronidase Activity of Soluble rHuPH20

Hyaluronidase activity of soluble rHuPH20 in samples such as cell cultures, purification fractions and purified solutions was determined using a turbidometric assay, which is based on the formation of an insoluble precipitate when hyaluronic acid binds with serum albumin. The activity is measured by incubating soluble rHuPH20 with sodium hyaluronate (hyaluronic acid) for a set period of time (10 minutes) and then precipitating the undigested sodium hyaluronate with the addition of acidified serum albumin. The turbidity of the resulting sample is measured at 640 nm after a 30 minute development period. The decrease in turbidity resulting from enzyme activity on the sodium hyaluronate substrate is a measure of the soluble rHuPH20 hyaluronidase activity. The method is performed using a calibration curve generated with dilutions of a soluble rHuPH20 assay working reference standard, and sample activity measurements are made relative to this calibration curve.

Dilutions of the sample were prepared in Enzyme Diluent Solution. The Enzyme Diluent Solution was prepared by dissolving 33.0±0.05 mg of hydrolyzed gelatin in 25.0 mL of the 50 mM PIPES Reaction Buffer (140 mM NaCl, 50 mM PIPES, pH 5.5) and 25.0 mL of SWFI, and diluting 0.2 mL of 25% Buminate solution into the mixture and vortexing for 30 seconds. This was performed within 2 hours of use and stored on ice until needed. The samples were diluted to an estimated 1-2 U/mL. Generally, the maximum dilution per step did not exceed 1:100 and the initial sample size for the first dilution was not be less than 20 µL. The minimum sample volumes needed to perform the assay were: In-process Samples, FPLC Fractions: 80 µL; Tissue Culture Supernatants:1 mL; Concentrated Material 80 µL; Purified or Final Step Material: 80 µL. The dilutions were made in triplicate in a Low Protein Binding 96-well plate, and 30 µL of each dilution was transferred to Optilux black/clear bottom plates (BD Biosciences).

Dilutions of known soluble rHuPH20 with a concentration of 2.5 U/mL were prepared in Enzyme Diluent Solution to generate a standard curve and added to the Optilux plate in triplicate. The dilutions included 0 U/mL, 0.25 U/mL, 0.5 U/mL, 1.0 U/mL, 1.5 U/mL, 2.0 U/mL, and 2.5 U/mL. "Reagent blank" wells that contained 60 µL of Enzyme Diluent Solution were included in the plate as a negative control. The plate was then covered and warmed on a heat block for 5 minutes at 37° C. The cover was removed and the plate was shaken for 10 seconds. After shaking, the plate was returned to the heat block and the MULTIDROP 384 Liquid Handling Device was primed with the warm 0.25 mg/mL sodium hyaluronate solution (prepared by dissolving 100 mg of sodium hyaluronate (LifeCore Biomedical) in 20.0 mL of SWFI. This was mixed by gently rotating and/or rocking at 2-8° C. for 2-4 hours, or until completely dissolved). The reaction plate was transferred to the MULTIDROP 384 and the reaction was initiated by pressing the start key to dispense 30 µL sodium hyaluronate into each well. The plate was then removed from the MULTIDROP 384 and shaken for 10 seconds before being transferred to a heat block with the plate cover replaced. The plate was incubated at 37° C. for 10 minutes The MULTIDROP 384 was prepared to stop the reaction by priming the machine with Serum Working Solution and changing the volume setting to 240 µL. (25 mL of Serum Stock Solution [1 volume of Horse Serum (Sigma) was diluted with 9 volumes of 500 mM Acetate Buffer Solution and the pH was adjusted to 3.1 with hydrochloric acid] in 75 mL of 500 mM Acetate Buffer Solution). The plate was removed from the heat block and placed onto the MULTIDROP 384 and 240 µL of serum Working Solutions was dispensed into the wells. The plate was removed and shaken on a plate reader for 10 seconds. After a further 15 minutes, the turbidity of the samples was measured at 640 nm and the hyaluronidase activity (in U/mL) of each sample was determined by fitting to the standard curve.

Specific activity (Units/mg) was calculated by dividing the hyaluronidase activity (U/ml) by the protein concentration (mg/mL).

Example 13

Production and Purification of Gen1 Human sPH20

A. 5 L Bioreactor Process

A vial of 3D35M was thawed and expanded from shaker flasks through 1 L spinner flasks in CD-CHO media (Invitrogen, Carlsbad Calif.) supplemented with 100 nM Methotrexate and GlutaMAX™-1 (Invitrogen). Cells were transferred from spinner flasks to a 5 L bioreactor (Braun) at an inoculation density of $4\times10^5$ viable cells per ml. Parameters were temperature Setpoint 37° C., pH 7.2 (starting Setpoint), with Dissolved Oxygen Setpoint 25% and an air overlay of 0-100 cc/min. At 168 hrs, 250 ml of Feed #1 Medium (CD CHO with 50 g/L Glucose) was added. At 216 hours, 250 ml of Feed #2 Medium (CD CHO with 50 g/L Glucose and 10 mM Sodium Butyrate) was added, and at 264 hours 250 ml of Feed #2 Medium was added. This process resulted in a final productivity of 1600 Units per ml with a maximal cell density of $6\times10^6$ cells/ml. The addition of sodium butyrate was to dramatically enhance the production of soluble rHuPH20 in the final stages of production.

Conditioned media from the 3D35M clone was clarified by depth filtration and tangential flow diafiltration into 10 mM Hepes pH 7.0. Soluble rHuPH20 was then purified by sequential chromatography on Q Sepharose (Pharmacia) ion exchange, Phenyl Sepharose (Pharmacia) hydrophobic interaction chromatography, phenyl boronate (Prometics) and Hydroxapatite Chromatography (Biorad, Richmond, Calif.).

Soluble rHuPH20 bound to Q Sepharose and eluted at 400 mM NaCl in the same buffer. The eluate was diluted with 2M ammonium sulfate to a final concentration of 500 mM ammonium sulfate and passed through a Phenyl Sepharose (low sub) column, followed by binding under the same conditions to a phenyl boronate resin. The soluble rHuPH20 was eluted from the phenyl sepharose resin in Hepes pH 6.9 after washing at pH 9.0 in 50 mM bicine without ammonium sulfate. The eluate was loaded onto a ceramic hydroxyapatite resin at pH 6.9 in 5 mM potassium phosphate and 1 mM $CaCl_2$ and eluted with 80 mM potassium phosphate, pH 7.4 with 0.1 mM $CaCl_2$.

The resultant purified soluble rHuPH20 possessed a specific activity in excess of 65,000 USP Units/mg protein by way of the microturbidity assay (Example 12) using the USP reference standard. Purified sPH20 eluted as a single peak from 24 to 26 minutes from a Pharmacia 5RPC styrene divinylbenzene column with a gradient between 0.1% TFA/$H_2O$ and 0.1% TFA/90% acetonitrile/10% $H_2O$ and resolved as a single broad 61 kDa band by SDS electrophoresis that reduced to a sharp 51 kDa band upon treatment with PNGASE-F. N-terminal amino acid sequencing revealed that the leader peptide had been efficiently removed.

B. Upstream Cell Culture Expansion Process into 100 L Bioreactor Cell Culture A scaled-up process was used to separately purify soluble rHuPH20 from four different vials of 3D35M cell to produce 4 separate batches of sHuPH20; HUA0406C, HUA0410C, HUA0415C and HUA0420C. Each vial was separately expanded and cultured through a 125 L bioreactor, then purified using column chromatography. Samples were taken throughout the process to assess such parameters as enzyme yield. The description of the process provided below sets forth representative specifications for such things as bioreactor starting and feed media volumes, transfer cell densities, and wash and elution volumes. The exact numbers vary slightly with each batch, and are detailed in Tables 24 to 30.

Four vials of 3D35M cells were thawed in a 37° C. water bath, CD CHO containing 100 nM methotrexate and 40 mL/L GlutaMAX was added and the cells were centrifuged. The cells were re-suspended in a 125 mL shake flask with 20 mL of fresh media and placed in a 37° C., 7% $CO_2$ incubator. The cells were expanded up to 40 mL in the 125 mL shake flask. When the cell density reached $1.5-2.5\times10^6$ cells/mL, the culture was expanded into a 125 mL spinner flask in a 100 mL culture volume. The flask was incubated at 37° C., 7% $CO_2$. When the cell density reached $1.5-2.5\times10^6$ cells/mL, the culture was expanded into a 250 mL spinner flask in 200 mL culture volume, and the flask was incubated at 37° C., 7% $CO_2$. When the cell density reached $1.5-2.5\times10^6$ cells/mL, the culture was expanded into a 1 L spinner flask in 800 mL culture volume and incubated at 37° C., 7% $CO_2$. When the cell density reached $1.5-2.5\times10^6$ cells/mL, the culture was expanded into a 6 L spinner flask in 5 L culture volume and incubated at 37° C., 7% $CO_2$. When the cell density reached $1.5-2.5\times10^6$ cells/mL, the culture was expanded into a 36 L spinner flask in 20 L culture volume and incubated at 37° C., 7% $CO_2$.

A 125 L reactor was sterilized with steam at 121° C., 20 PSI and 65 L of CD CHO media was added. Before use, the reactor was checked for contamination. When the cell density in the 36 L spinner flasks reached $1.8-2.5\times10^6$ cells/mL, 20 L cell culture were transferred from the 36 L spinner flasks to the 125 L bioreactor (Braun), resulting a final volume of 85 L and a seeding density of approximately $4\times10^5$ cells/mL. Parameters were temperature setpoint, 37° C.; pH: 7.2; Dissolved oxygen: 25%±10%; Impeller Speed 50 rpm; Vessel Pressure 3 psi; Air Sparge 1 L/min.; Air Overlay: 1 L/min. The reactor was sampled daily for cell counts, pH verification, media analysis, protein production and retention. Nutrient feeds were added during the run. At Day 6, 3.4 L of Feed #1 Medium (CD CHO+50 g/L Glucose+40 mL/L GlutaMAX™-1) was added, and culture temperature was changed to 36.5° C. At day 9, 3.5 L of Feed #2 (CD CHO+50 g/L Glucose+40 mL/L GlutaMAX™-1+1.1 g/L Sodium Butyrate) was added, and culture temperature was changed to 36° C. At day 11, 3.7 L of Feed #3 (CD CHO+50 g/L Glucose+40 mL/L GlutaMAX™-1+1.1 g/L Sodium Butyrate) was added, and the culture temperature was changed to 35.5° C. The reactor was harvested at 14 days or when the viability of the cells dropped below 50%. The process resulted in production of soluble rHuPH20 with an enzymatic activity of 1600 Units/ml with a maximal cell density of 8 million cells/mL. At harvest, the culture was sampled for mycoplasma, bioburden, endotoxin, and virus in vitro and in vivo, transmission electron microscopy (TEM) for viral particles, and enzyme activity.

The one hundred liter bioreactor cell culture harvest was filtered through a series of disposable capsule filters having a polyethersulfone medium (Sartorius): first through a 8.0 μm depth capsule, a 0.65 μm depth capsule, a 0.22 μm capsule, and finally through a 0.22 μm Sartopore 2000 $cm^2$ filter and into a 100 L sterile storage bag. The culture was concentrated 10× using two TFF with Spiral Polyethersulfone 30 kDa MWCO filters (Millipore), followed by a 6× buffer exchange with 10 mM HEPES, 25 mM $Na_2SO_4$, pH 7.0 into a 0.22 μm final filter into a 20 L sterile storage bag. Table 19 provides monitoring data related to the cell culture, harvest, concentration and buffer exchange steps.

TABLE 19

Monitoring data for cell culture, harvest, concentration and buffer exchange steps.

| Parameter | HUA0406C | HUA04010C | HUA0415C | HUA0420C |
|---|---|---|---|---|
| Time from thaw to inoculate 100 L bioreactor (days) | 21 | 19 | 17 | 18 |
| 100 L inoculation density (×10$^6$ cells/mL) | 0.45 | 0.33 | 0.44 | 0.46 |
| Doubling time in logarithmic growth (hr) | 29.8 | 27.3 | 29.2 | 23.5 |
| Max. cell density (×10$^6$ cells/mL) | 5.65 | 8.70 | 6.07 | 9.70 |
| Harvest viability (%) | 41 | 48 | 41 | 41 |
| Harvest titer (U/ml) | 1964 | 1670 | 991 | 1319 |
| Time in 100-L bioreactor (days) | 13 | 13 | 12 | 13 |
| Clarified harvest volume (mL) | 81800 | 93300 | 91800 | 89100 |
| Clarified harvest enzyme assay (U/mL) | 2385 | 1768 | 1039 | 1425 |
| Concentrate enzyme assay (U/mL) | 22954 | 17091 | 8561 | 17785 |
| Buffer exchanged concentrate enzyme assay (U/mL) | 15829 | 11649 | 9915 | 8679 |
| Filtered buffer exchanged concentrate enzyme assay (U/mL) | 21550 | 10882 | 9471 | 8527 |
| Buffer exchanged concentrate volume(mL) | 10699 | 13578 | 12727 | 20500 |
| Ratio enzyme units concentration/harvest | 0.87 | 0.96 | 1.32 | 1.4 |

A Q Sepharose (Pharmacia) ion exchange column (3 L resin, Height=20 cm, Diameter=14 cm) was prepared. Wash samples were collected for a determination of pH, conductivity and endotoxin (LAL) assay. The column was equilibrated with 5 column volumes of 10 mM Tris, 20 mM Na$_2$SO$_4$, pH 7.5. The concentrated, diafiltered harvest was loaded onto the Q column at a flow rate of 100 cm/hr. The column was washed with 5 column volumes of 10 mM Tris, 20 mM Na$_2$SO$_4$, pH 7.5 and 10 mM Hepes, 50 mM NaCl, pH 7.0. The protein was eluted with 10 mM Hepes, 400 mM NaCl, pH 7.0 and filtered through a 0.22 μm final filter into a sterile bag.

Phenyl-Sepharose (Pharmacia) hydrophobic interaction chromatography was next performed. A Phenyl-Sepharose (PS) column (9.1 L resin, Height=29 cm, Diameter=20 cm) was prepared. The column was equilibrated with 5 column volumes of 5 mM potassium phosphate, 0.5 M ammonium sulfate, 0.1 mM CaCl$_2$, pH 7.0. The protein eluate from above was supplemented with 2M ammonium sulfate, 1 M potassium phosphate and 1 M CaCl$_2$ stock solutions to final concentrations of 5 mM, 0.5 M and 0.1 mM, respectively. The protein was loaded onto the PS column at a flow rate of 100 cm/hr. 5 mM potassium phosphate, 0.5 M ammonium sulfate and 0.1 mM CaCl$_2$ pH 7.0 was added at 100 cm/hr. The flow through was passed through a 0.22 μm final filter into a sterile bag.

The PS-purified protein was the loaded onto an aminophenyl boronate column (ProMedics) (6.3 L resin, Height=20 cm, Diameter=20 cm) that had been equilibrated with 5 column volumes of 5 mM potassium phosphate, 0.5 M ammonium sulfate. The protein was passed through the column at a flow rate of 100 cm/hr, and the column was washed with 5 mM potassium phosphate, 0.5 M ammonium sulfate, pH 7.0. The column was then washed with 20 mM bicine, 100 mM NaCl, pH 9.0 and the protein eluted with 50 mM Hepes, 100 mM NaCl pH 6.9 through a sterile filter and into a 20 L sterile bag. The eluate was tested for bioburden, protein concentration and enzyme activity.

A hydroxyapatite (HAP) column (BioRad) (1.6 L resin, Height=10 cm, Diameter=14 cm) was equilibrated with 5 mM potassium phosphate, 100 mM NaCl, 0.1 mM CaCl$_2$ pH 7.0. Wash samples were collected and tested for pH, conductivity and endotoxin (LAL assay. The aminophenyl boronate purified protein was supplemented with potassium phosphate and CaCl$_2$ to yield final concentrations of 5 mM potassium phosphate and 0.1 mM CaCl$_2$ and loaded onto the HAP column at a flow rate of 100 cm/hr. The column was washed with 5 mM potassium phosphate pH 7.0, 100 mM NaCl, 0.1 mM CaCl$_2$, then 10 mM potassium phosphate pH 7.0, 100 mM NaCl, 0.1 mM CaCl$_2$ pH. The protein was eluted with 70 mM potassium phosphate pH 7.0 and filtered through a 0.22 μm filter into a 5 L sterile storage bag. The eluate was tested for bioburden, protein concentration and enzyme activity.

The HAP-purified protein was then pumped through a 20 nM viral removal filter via a pressure tank. The protein was added to the DV20 pressure tank and filter (Pall Corporation), passing through an Ultipor DV20 Filter with 20 nm pores (Pall Corporation) into a sterile 20 L storage bag. The filtrate was tested for protein concentration, enzyme activity, oligosaccharide, monosaccharide and sialic acid profiling, and process-related impurities. The protein in the filtrate was then concentrated to 1 mg/mL using a 10 kD molecular weight cut off (MWCO) Sartocon Slice tangential flow filtration (TFF) system (Sartorius). The filter was first prepared by washing with a Hepes/saline solution (10 mM Hepes, 130 mM NaCl, pH 7.0) and the permeate was sampled for pH and conductivity. Following concentration, the concentrated protein was sampled and tested for protein concentration and enzyme activity. A 6× buffer exchange was performed on the concentrated protein into the final buffer: 10 mM Hepes, 130 mM NaCl, pH 7.0. The concentrated protein was passed though a 0.22 μm filter into a 20 L sterile storage bag. The protein was sampled and tested for protein concentration, enzyme activity, free sulfhydryl groups, oligosaccharide profiling and osmolarity.

Tables 20 to 26 provide monitoring data related to each of the purification steps described above, for each 3D35M cell lot.

TABLE 20

Q sepharose column data

| Parameter | HUA0406C | HUA0410C | HUA0415C | HUA0420C |
|---|---|---|---|---|
| Load volume (mL) | 10647 | 13524 | 12852 | 20418 |
| Load Volume/Resin Volume ratio | 3.1 | 4.9 | 4.5 | 7.3 |
| Column Volume (mL) | 2770 | 3840 | 2850 | 2880 |
| Eluate volume (mL) | 6108 | 5923 | 5759 | 6284 |
| Protein Conc. of Eluate (mg/mL) | 2.8 | 3.05 | 2.80 | 2.86 |
| Eluate Enzyme Assay (U/mL) | 24493 | 26683 | 18321 | 21052 |
| Enzyme Yield (%) | 65 | 107 | 87 | 76 |

TABLE 21

Phenyl Sepharose column data

| Parameter | HUA0406C | HUA0410C | HUA0415C | HUA0420C |
|---|---|---|---|---|
| Volume Before Stock Solution Addition (mL) | 5670 | 5015 | 5694 | 6251 |
| Load Volume (mL) | 7599 | 6693 | 7631 | 8360 |
| Column Volume (mL) | 9106 | 9420 | 9340 | 9420 |
| Load Volume/Resin Volume ratio | 0.8 | 0.71 | 0.82 | 0.89 |
| Eluate volume (mL) | 16144 | 18010 | 16960 | 17328 |
| Protein Conc of Eluate (mg/mL) | 0.4 | 0.33 | 0.33 | 0.38 |
| Eluate Enzyme Assay (U/mL) | 8806 | 6585 | 4472 | 7509 |
| Protein Yield (%) | 41 | 40 | 36 | 37 |
| Enzyme Yield (%) | 102 | 88 | 82 | 96 |

TABLE 22

Amino Phenyl Boronate column data

| Parameter | HUA0406C | HUA0410C | HUA0415C | HUA0420C |
|---|---|---|---|---|
| Load Volume (mL) | 16136 | 17958 | 16931 | 17884 |
| Load Volume/Resin Volume ratio | 2.99 | 3.15 | 3.08 | 2.98 |
| Column Volume (mL) | 5400 | 5700 | 5500 | 5300 |
| Eluate volume (mL) | 17595 | 22084 | 20686 | 19145 |
| Protein Conc. of Eluate (mg/mL) | 0.0 | 0.03 | 0.03 | 0.04 |
| Protein Conc. of Filtered Eluate (mg/mL) | not tested | 0.03 | 0.00 | 0.04 |
| Eluate Enzyme Assay (U/mL) | 4050 | 2410 | 1523 | 4721 |
| Protein Yield (%) | 0 | 11 | 11 | 12 |
| Enzyme Yield (%) | not determined | 41 | 40 | 69 |

TABLE 23

Hydroxyapatite column data

| Parameter | HUA0406C | HUA0410C | HUA0415C | HUA0420C |
|---|---|---|---|---|
| Volume Before Stock Solution Addition (mL) | 16345 | 20799 | 20640 | 19103 |
| Load Volume/Resin Volume ratio | 10.95 | 13.58 | 14.19 | 12.81 |
| Column Volume (mL) | 1500 | 1540 | 1462 | 1500 |
| Load volume (mL) | 16429 | 20917 | 20746 | 19213 |
| Eluate volume (mL) | 4100 | 2415 | 1936 | 2419 |
| Protein Conc. of Eluate (mg/mL) | not tested | 0.24 | 0.17 | 0.23 |
| Protein Conc. of Filtered Eluate (mg/mL) | NA | NA | 0.17 | NA |
| Eluate Enzyme Assay (U/mL) | 14051 | 29089 | 20424 | 29826 |
| Protein Yield (%) | Not tested | 93 | 53 | 73 |
| Enzyme Yield (%) | 87 | 118 | 140 | 104 |

TABLE 24

DV20 filtration data

| Parameter | HUA0406C | HUA0410C | HUA0415C | HUA0420C |
|---|---|---|---|---|
| Start volume (mL) | 4077 | 2233 | 1917 | 2419 |
| Filtrate Volume (mL) | 4602 | 3334 | 2963 | 3504 |
| Protein Conc. of Filtrate (mg/mL) | 0.1 | NA | 0.09 | NA |
| Protein Conc. of Filtered Eluate (mg/mL) | NA | 0.15 | 0.09 | 0.16 |
| Protein Yield (%) | not tested | 93 | 82 | 101 |

TABLE 25

Final concentration data

| Parameter | HUA0406C | HUA0410C | HUA0415C | HUA0420C |
|---|---|---|---|---|
| Start volume (mL) | 4575 | 3298 | 2963 | 3492 |
| Concentrate Volume (mL) | 562 | 407 | 237 | 316 |
| Protein Conc. of Concentrate (mg/mL) | 0.9 | 1.24 | 1.16 | 1.73 |

TABLE 25-continued

Final concentration data

| Parameter | HUA0406C | HUA0410C | HUA0415C | HUA0420C |
|---|---|---|---|---|
| Protein Yield (%) | 111 | 102 | 103 | 98 |

TABLE 26

Buffer Exchange into Final Formulation data

| Parameter | HUA0406C | HUA0410C | HUA0415C | HUA0420C |
|---|---|---|---|---|
| Start Volume (mL) | 562 | 407 | 237 | 316 |
| Final Volume Buffer Exchanged Concentrate (mL) | 594 | 516 | 310 | 554 |
| Protein Conc. of Concentrate (mg/mL) | 1.00 | 0.97 | 0.98 | 1.00 |
| Protein Conc. of Filtered Concentrate (mg/mL) | 0.95 | 0.92 | 0.95 | 1.02 |
| Protein Yield (%) | 118 | 99 | 110 | 101 |

The purified and concentrated soluble rHuPH20 protein was aseptically filled into sterile vials with 5 mL and 1 mL fill volumes. The protein was passed though a 0.22 µm filter to an operator controlled pump that was used to fill the vials using a gravimetric readout. The vials were closed with stoppers and secured with crimped caps. The closed vials were visually inspected for foreign particles and then labeled. Following labeling, the vials were flash-frozen by submersion in liquid nitrogen for no longer than 1 minute and stored at ≤15° C. (−20±5° C.).

Example 14

Production Gen2 Cells Containing Soluble Human PH20 (rHuPH20)

The Gen1 3D35M cell line described in Example 13 was adapted to higher methotrexate levels to produce generation 2 (Gen2) clones. 3D35M cells were seeded from established methotrexate-containing cultures into CD CHO medium containing 4 mM GlutaMAX-1™ and 1.0 µM methotrexate. The cells were adapted to a higher methotrexate level by growing and passaging them 9 times over a period of 46 days in a 37° C., 7% $CO_2$ humidified incubator. The amplified population of cells was cloned out by limiting dilution in 96-well tissue culture plates containing medium with 2.0 µM methotrexate. After approximately 4 weeks, clones were identified and clone 3E10B was selected for expansion. 3E10B cells were grown in CD CHO medium containing 4 mM GlutaMAX-1™ and 2.0 µM methotrexate for 20 passages. A master cell bank (MCB) of the 3E10B cell line was created and frozen and used for subsequent studies.

Amplification of the cell line continued by culturing 3E10B cells in CD CHO medium containing 4 mM GlutaMAX-1™ and 4.0 µM methotrexate. After the $12^{th}$ passage, cells were frozen in vials as a research cell bank (RCB). One vial of the RCB was thawed and cultured in medium containing 8.0 µM methotrexate. After 5 days, the methotrexate concentration in the medium was increased to 16.0 µM, then 20.0 µM 18 days later. Cells from the $8^{th}$ passage in medium containing 20.0 µM methotrexate were cloned out by limiting dilution in 96-well tissue culture plates containing CD CHO medium containing 4 mM GlutaMAX-1™ and 20.0 µM methotrexate. Clones were identified 5-6 weeks later and clone 2B2 was selected for expansion in medium containing 20.0 µM methotrexate. After the 11th passage, 2B2 cells were frozen in vials as a research cell bank (RCB).

The resultant 2B2 cells are dihydrofolate reductase deficient (dhfr−) DG44 CHO cells that express soluble recombinant human PH20 (rHuPH20). The soluble PH20 is present in 2B2 cells at a copy number of approximately 206 copies/cell. Southern blot analysis of Spe I-, Xba I- and BamH I/Hind III-digested genomic 2B2 cell DNA using a rHuPH20-specific probe revealed the following restriction digest profile: one major hybridizing band of ~7.7 kb and four minor hybridizing bands (~13.9, ~6.6, ~5.7 and ~4.6 kb) with DNA digested with Spe I; one major hybridizing band of ~5.0 kb and two minor hybridizing bands (~13.9 and ~6.5 kb) with DNA digested with Xba I; and one single hybridizing band of ~1.4 kb observed using 2B2 DNA digested with BamH I/Hind III. Sequence analysis of the mRNA transcript indicated that the derived cDNA (SEQ ID NO:139) was identical to the reference sequence (SEQ ID NO:110) except for one base pair difference at position 1131, which was observed to be a thymidine (T) instead of the expected cytosine (C). This is a silent mutation, with no effect on the amino acid sequence.

Example 15

A. Production of Gen2 Soluble rHuPH20 in 300 L Bioreactor Cell Culture

A vial of HZ24-2B2 was thawed and expanded from shaker flasks through 36 L spinner flasks in CD-CHO media (Invitrogen, Carlsbad, Calif.) supplemented with 20 µM methotrexate and GlutaMAX-1™ (Invitrogen). Briefly, the vial of cells was thawed in a 37° C. water bath, media was added and the cells were centrifuged. The cells were re-suspended in a 125 mL shake flask with 20 mL of fresh media and placed in a 37° C., 7% $CO_2$ incubator. The cells were expanded up to 40 mL in the 125 mL shake flask. When the cell density reached greater than $1.5 \times 10^6$ cells/mL, the culture was expanded into a 125 mL spinner flask in a 100 mL culture volume. The flask was incubated at 37° C., 7% $CO_2$. When the cell density reached greater than $1.5 \times 10^6$ cells/mL, the culture was expanded into a 250 mL spinner flask in 200 mL culture volume, and the flask was incubated at 37° C., 7% $CO_2$. When the cell density reached greater than $1.5 \times 10^6$ cells/mL, the culture was expanded into a 1 L spinner flask in 800 mL culture volume and incubated at 37° C., 7% $CO_2$. When the cell density reached greater than $1.5 \times 10^6$ cells/mL the culture was expanded into a 6 L spinner flask in 5000 mL culture volume and incubated at 37° C., 7% $CO_2$. When the cell density reached greater than $1.5 \times 10^6$ cells/mL the culture was expanded into a 36 L spinner flask in 32 L culture volume and incubated at 37° C., 7% $CO_2$.

A 400 L reactor was sterilized and 230 mL of CD-CHO media was added. Before use, the reactor was checked for contamination. Approximately 30 L cells were transferred from the 36 L spinner flasks to the 400 L bioreactor (Braun) at an inoculation density of $4.0 \times 10^5$ viable cells per ml and a total volume of 260 L. Parameters were temperature setpoint, 37° C.; Impeller Speed 40-55 RPM; Vessel Pressure: 3 psi; Air Sparge 0.5-1.5 L/Min.; Air Overlay: 3 L/min. The reactor was sampled daily for cell counts, pH verification, media analysis, protein production and retention. Also, during the run nutrient feeds were added. At 120 hrs (day 5), 10.4 L of Feed #1 Medium (4×CD-CHO+33 g/L Glucose+160 mL/L Glutamax-1™+83 mL/L Yeastolate+33 mg/L rHuInsulin) was added. At 168 hours (day 7), 10.8 L of Feed #2 (2×CD-CHO+33 g/L Glucose+80 mL/L Glutamax-1™+167 mL/L Yeastolate+0.92 g/L Sodium Butyrate) was added, and culture temperature was changed to 36.5° C. At 216 hours (day 9), 10.8 L of Feed #3 (1×CD-CHO+50 g/L Glucose+50 mL/L Glutamax-1™+250 mL/L Yeastolate+1.80 g/L Sodium Butyrate) was added, and culture temperature was changed to 36° C. At 264 hours (day 11), 10.8 L of Feed #4 (1×CD-CHO+33 g/L Glucose+33 mL/L Glutamax-1™+250 mL/L Yeastolate+0.92 g/L Sodium Butyrate) was added, and culture temperature was changed to 35.5° C. The addition of the feed media was observed to dramatically enhance the production of soluble rHuPH20 in the final stages of production. The reactor was harvested at 14 or 15 days or when the viability of the cells dropped below 40%. The process resulted in a final productivity of 17,000 Units per ml with a maximal cell density of 12 million cells/mL. At harvest, the culture was sampled for mycoplasma, bioburden, endotoxin and viral in vitro and in vivo, Transmission Electron Microscopy (TEM) and enzyme activity.

The culture was pumped by a peristaltic pump through four Millistak filtration system modules (Millipore) in parallel, each containing a layer of diatomaceous earth graded to 4-8 μm and a layer of diatomaceous earth graded to 1.4-1.1 μm, followed by a cellulose membrane, then through a second single Millistak filtration system (Millipore) containing a layer of diatomaceous earth graded to 0.4-0.11 μm and a layer of diatomaceous earth graded to <0.1 μm, followed by a cellulose membrane, and then through a 0.22 μm final filter into a sterile single use flexible bag with a 350 L capacity. The harvested cell culture fluid was supplemented with 10 mM EDTA and 10 mM Tris to a pH of 7.5. The culture was concentrated 10× with a tangential flow filtration (TFF) apparatus using four Sartoslice TFF 30 kDa molecular weight cut-off (MWCO) polyether sulfone (PES) filter (Sartorious), followed by a 10× buffer exchange with 10 mM Tris, 20 mM $Na_2SO_4$, pH 7.5 into a 0.22 μm final filter into a 50 L sterile storage bag.

The concentrated, diafiltered harvest was inactivated for virus. Prior to viral inactivation, a solution of 10% Triton® X-100, 3% tri (n-butyl) phosphate (TNBP) was prepared. The concentrated, diafiltered harvest was exposed to 1% Triton® X-100, 0.3% TNBP for 1 hour in a 36 L glass reaction vessel immediately prior to purification on the Q column.

B. Purification of Gen2 Soluble rHuPH20

A Q Sepharose (Pharmacia) ion exchange column (9 L resin, H=29 cm, D=20 cm) was prepared. Wash samples were collected for a determination of pH, conductivity and endotoxin (LAL) assay. The column was equilibrated with 5 column volumes of 10 mM Tris, 20 mM Na2SO4, pH 7.5. Following viral inactivation, the concentrated, diafiltered harvest was loaded onto the Q column at a flow rate of 100 cm/hr. The column was washed with 5 column volumes of 10 mM Tris, 20 mM Na2SO4, pH 7.5 and 10 mM Hepes, 50 mM NaCl, pH7.0. The protein was eluted with 10 mM Hepes, 400 mM NaCl, pH 7.0 into a 0.22 μm final filter into sterile bag. The eluate sample was tested for bioburden, protein concentration and hyaluronidase activity. $A_{280}$ absorbance reading were taken at the beginning and end of the exchange.

Phenyl-Sepharose (Pharmacia) hydrophobic interaction chromatography was next performed. A Phenyl-Speharose (PS) column (19-21 L resin, H=29 cm, D=30 cm) was prepared. The wash was collected and sampled for pH, conductivity and endotoxin (LAL assay). The column was equilibrated with 5 column volumes of 5 mM potassium phosphate, 0.5 M ammonium sulfate, 0.1 mM $CaCl_2$, pH 7.0. The protein eluate from the Q sepharose column was supplemented with 2M ammonium sulfate, 1 M potassium phosphate and 1 M $CaCl_2$ stock solutions to yield final concentrations of 5 mM, 0.5 M and 0.1 mM, respectively. The protein was loaded onto the PS column at a flow rate of 100 cm/hr and the column flow thru collected. The column was washed with 5 mM potassium phosphate, 0.5 M ammonium sulfate and 0.1 mM $CaCl_2$ pH 7.0 at 100 cm/hr and the wash was added to the collected flow thru. Combined with the column wash, the flow through was passed through a 0.22 lam final filter into a sterile bag. The flow through was sampled for bioburden, protein concentration and enzyme activity.

An aminophenyl boronate column (Prometics) was prepared. The wash was collected and sampled for pH, conductivity and endotoxin (LAL assay). The column was equilibrated with 5 column volumes of 5 mM potassium phosphate, 0.5 M ammonium sulfate. The PS flow through containing purified protein was loaded onto the aminophenyl boronate column at a flow rate of 100 cm/hr. The column was washed with 5 mM potassium phosphate, 0.5 M ammonium sulfate, pH 7.0. The column was washed with 20 mM bicine, 0.5 M ammonium sulfate, pH 9.0. The column was washed with 20 mM bicine, 100 mM sodium chloride, pH 9.0. The protein was eluted with 50 mM Hepes, 100 mM NaCl, pH 6.9 and passed through a sterile filter into a sterile bag. The eluted sample was tested for bioburden, protein concentration and enzyme activity.

The hydroxyapatite (HAP) column (Biorad) was prepared. The wash was collected and tested for pH, conductivity and endotoxin (LAL assay). The column was equilibrated with 5 mM potassium phosphate, 100 mM NaCl, 0.1 mM $CaCl_2$, pH 7.0. The aminophenyl boronate purified protein was supplemented to final concentrations of 5 mM potassium phosphate and 0.1 mM $CaCl_2$ and loaded onto the HAP column at a flow rate of 100 cm/hr. The column was washed with 5 mM potassium phosphate, pH 7, 100 mM NaCl, 0.1 mM $CaCl_2$. The column was next washed with 10 mM potassium phosphate, pH 7, 100 mM NaCl, 0.1 mM $CaCl_2$. The protein was eluted with 70 mM potassium phosphate, pH 7.0 and passed through a 0.22 μm sterile filter into a sterile bag. The eluted sample was tested for bioburden, protein concentration and enzyme activity.

The HAP purified protein was then passed through a viral removal filter. The sterilized Viosart filter (Sartorius) was first prepared by washing with 2 L of 70 mM potassium phosphate, pH 7.0. Before use, the filtered buffer was sampled for pH and conductivity. The HAP purified protein was pumped via a peristaltic pump through the 20 nM viral removal filter. The filtered protein in 70 mM potassium phosphate, pH 7.0 was passed through a 0.22 μm final filter into a sterile bag. The viral filtered sample was tested for protein concentration, enzyme activity, oligosaccharide, monosaccharide and sialic acid profiling. The sample also was tested for process related impurities.

The protein in the filtrate was then concentrated to 10 mg/mL using a 10 kD molecular weight cut off (MWCO) Sartocon Slice tangential flow filtration (TFF) system (Sartorius). The filter was first prepared by washing with 10 mM histidine, 130 mM NaCl, pH 6.0 and the permeate was sampled for pH and conductivity. Following concentration, the concentrated protein was sampled and tested for protein concentration and enzyme activity. A 6× buffer exchange was performed on the concentrated protein into the final buffer: 10 mM histidine, 130 mM NaCl, pH 6.0. Following buffer exchange, the concentrated protein was passed though a 0.22 μm filter into a 20 L sterile storage bag. The protein was sampled and tested for protein concentration, enzyme activity, free sulfhydryl groups, oligosaccharide profiling and osmolarity.

The sterile filtered bulk protein was then aseptically dispensed at 20 mL into 30 mL sterile Teflon vials (Nalgene). The vials were then flash frozen and stored at −20±5° C.

C. Comparison of Production and Purification of Gen1 Soluble rHuPH20 and Gen2 Soluble rHuPH20

The production and purification of Gen2 soluble rHuPH20 in a 300 L bioreactor cell culture contained some changes in the protocols compared to the production and purification Gen1 soluble rHuPH20 in a 100 L bioreactor cell culture (described in Example 13B). Table 27 sets forth exemplary differences, in addition to simple scale up changes, between the methods.

TABLE 27

| Process Difference | Gen1 soluble rHuPH20 | Gen2 soluble rHuPH20 |
|---|---|---|
| Cell line | 3D35M | 2B2 |
| Media used to expand cell inoculum | Contains 0.10 μM methotrexate (0.045 mg/L) | Contains 20 μM methotrexate (9 mg/L) |
| Media in 6 L cultures onwards | Contains 0.10 μM methotrexate | Contains no methotrexate |
| 36 L spinner flask | No instrumentation 20 L operating volume. | Equipped with instrumentation that monitors and controls pH, dissolved oxygen, sparge and overlay gas flow rate. 32 L operating volume |
| Final operating volume in bioreactor | Approx. 100 L in a 125 L bioreactor (initial culture volume + 65 L) | Approx. 300 L in a 400 L bioreactor (initial culture volume + 260 L) |
| Culture media in final bioreactor | No rHuInsulin | 5.0 mg/L rHuInsulin |
| Media feed volume | Scaled at 4% of the bioreactor cell culture volume i.e. 3.4, 3.5 and 3.7 L, resulting in a target bioreactor volume of ~92 L. | Scaled at 4% of the bioreactor cell culture volume i.e. 10.4, 10.8, 11.2 and 11.7 L, resulting in a target bioreactor volume of ~303 L. |
| Media feed | Feed #1 Medium: CD CHO + 50 g/L Glucose + 8 mM GlutaMAX ™-1 Feed #2 (CD CHO + 50 g/L Glucose + 8 mM GlutaMAX + 1.1 g/L Sodium Butyrate Feed #3: CD CHO + 50 g/L Glucose + 8 mM GlutaMAX + 1.1 g/L Sodium Butyrate | Feed #1 Medium: 4x CD CHO + 33 g/L Glucose + 32 mM Glutamax + 16.6 g/L Yeastolate + 33 mg/L rHuInsulin Feed #2: 2x CD CHO + 33 g/L Glucose + 16 mM Glutamax + 33.4 g/L Yeastolate + 0.92 g/L Sodium Butyrate Feed #3: 1x CD CHO + 50 g/L Glucose + 10 mM Glutamax + 50 g/L Yeastolate + 1.80 g/L Sodium Butyrate Feed #4: 1x CD CHO + 33 g/L Glucose + 6.6 mM Glutamax + 50 g/L Yeastolate + 0.92 g/L Sodium Butyrate |
| Filtration of bioreactor cell culture | Four polyethersulfone filters (8.0 μm, 0.65 μm, 0.22 μm and 0.22 μm) in series 100 L storage bag | $1^{st}$ stage - Four modules in parallel, each with a layer of diatomaceous earth graded to 4-8 μm and a layer of diatomaceous earth graded to 1.4-1.1 μm, followed by a cellulose membrane. $2^{nd}$ stage - single module containing a layer of diatomaceous earth graded to 0.4-0.11 μm and a layer of diatomaceous earth graded to <0.1 μm, followed by a cellulose membrane. $3^{rd}$ stage - 0.22 μm polyethersulfone filter 300 L storage bag |

TABLE 27-continued

| Process Difference | Gen1 soluble rHuPH20 | Gen2 soluble rHuPH20 |
|---|---|---|
| Concentration and buffer exchange prior to chromatography | Concentrate with 2 TFF with Millipore Spiral Polyethersulfone 30K MWCO Filter Buffer Exchange the Concentrate 6x with 10 mM Hepes, 25 mM NaCl, pH 7.0 20 L sterile storage bag | Harvested cell culture is supplemented with 10 mM EDTA, 10 mM Tris to a pH of 7.5. Concentrate using four Sartorius Sartoslice TFF 30K MWCO Filter Buffer Exchange the Concentrate 10x with 10 mM Tris, 20 mM Na2SO4, pH 7.5 50 L sterile storage bag |
| Viral inactivation prior to chromatography | None | Viral inactivation performed with the addition of a 1% Triton ® X-100, 0.3% Tributyl Phosphate, pH 7.5, |
| 1st purification step (Q sepharose) | No absorbance reading | A280 measurements at the beginning and end |
| Viral filtration after chromatography | Pall DV-20 filter (20 nm) | Sartorius Virosart filter (20 nm) |
| Concentration and buffer exchange after chromatography | Hepes/saline pH 7.0 buffer Protein concentrated to 1 mg/ml | Histidine/saline, pH 6.0 buffer Protein concentrated to 10 mg/ml |

Example 16

Determination of Sialic Acid and Monosaccharide Content

The sialic acid and monosaccharide content of soluble rHuPH20 can be assessed by reverse phase liquid chromatography (RPLC) following hydrolysis with trifluoroacetic acid. In one example, the sialic acid and monosaccharide content of purified hyaluronidase lot #HUB0701E (1.2 mg/mL; produced and purified essentially as described in Example 15) was determined. Briefly, 100 µg sample was hydrolyzed with 40% (v/v) trifluoroacetic acid at 100° C. for 4 hours in duplicate. Following hydrolysis, the samples were dried down and resuspended in 300 µL water. A 45 µL aliquot from each re-suspended sample was transferred to a new tube and dried down, and 10 µL of a 10 mg/mL sodium acetate solution was added to each. The released monosaccharides were fluorescently labeled by the addition of 50 µL of a solution containing 30 mg/mL 2-aminobenzoic acid, 20 mg/mL sodium cyanoborohydride, approximately 40 mg/mL sodium acetate and 20 mg/mL boric acid in methanol. The mixture was incubated for 30 minutes at 80° C. in the dark. The derivitization reaction was quenched by the addition of 440 µL of mobile phase A (0.2% (v/v) n-butylamine, 0.5% (v/v) phosphoric acid, 1% (v/v) tetrahydrofuran). A matrix blank of water also was hydrolyzed and derivitized as described for the hyaluronidase sample as a negative control. The released monosaccharides were separated by RPLC using an Octadecyl ($C_{18}$) reverse phase column (4.6×250 mm, 5 µm particle size; J. T. Baker) and monitored by fluorescence detection (360 nm excitation, 425 nm emission). Quantitation of the monosaccharide content was made by comparison of the chromatograms from the hyaluronidase sample with chromatograms of monosaccharide standards including N-D-glucosamine (GlcN), N-D-galactosamine (GalN), galactose, fucose and mannose. Table 28 presents the molar ratio of each monosaccharide per hyaluronidase molecule.

TABLE 28

| Monosaccharide content of soluble rHuPH20 | | | | | | |
|---|---|---|---|---|---|---|
| Lot | Replicate | GlcN | GalN | Galactose | Mannose | Fucose |
| HUB0701E | 1 | 14.28 | 0.07* | 6.19 | 25.28 | 2.69 |
|  | 2 | 13.66 | 0.08* | 6.00 | 24.34 | 2.61 |
|  | Average | 13.97 | 0.08* | 6.10 | 24.81 | 2.65 |

*GalN results were below the limit of detection

Example 17

C-Terminal Heterogeneity of Soluble rHuPH20 from 3D35M and 2B2 Cells

C-terminal sequencing was performed on two lots of sHuPH20 produced and purified from 3D35M cells in a 100 L bioreactor volume (Lot HUA0505MA) and 2B2 cells in a 300 L bioreactor volume (Lot HUB0701EB). The lots were separately digested with endoproteinase Asp-N, which specifically cleaves peptide bonds N-terminally at aspartic and cysteic acid. This releases the C-terminal portion of the soluble rHuPH20 at the aspartic acid at position 431 of SEQ ID NO:122. The C-terminal fragments were separated and characterized to determine the sequence and abundance of each population in Lot HUA0505MA and Lot HUB0701EB.

It was observed that the soluble rHuPH20 preparations from 3D35M cells and 2B2 cells displayed heterogeneity, and contained polypeptides that differed from one another in their C-terminal sequence (Tables 30 and 31). This heterogeneity is likely the result of C-terminal cleavage of the expressed 447 amino acid polypeptide (SEQ ID NO:122) by peptidases present in the cell culture medium or other solutions during the production and purification process. The polypeptides in the soluble rHuPH20 preparations have amino acid sequences corresponding to amino acids 1-447, 1-446, 1-445, 1-444 and 1-443 of the soluble rHuPH20 sequence set forth SEQ ID NO:122. The full amino acid sequence of each of these polypeptides is forth in SEQ ID NOS: 122 to 126, respectively. As noted in tables 29 and 30, the abundance of each polypeptide in the soluble rHuPH20 preparations from 3D35M cells and 2B2 cells differs.

TABLE 29

Analysis of C-terminal fragments from Lot HUA0505MA

| Fragment | Amino acid position (relative to SEQ ID NO: 122) | Sequence | Theor. mass | Exp. Mass | Error | Elution time | Abundance |
|---|---|---|---|---|---|---|---|
| D28a | 431-447 | DAFKLPPMETEEPQIFY (SEQ ID NO: 191) | 2053.97 | 2054.42 | 0.45 | 99.87 | 0.2% |
| D28b | 431-446 | DAFLKPPMETEEPQIF (SEQ ID NO: 192) | 1890.91 | 1891.28 | 0.37 | 97.02 | 18.4% |
| D28c | 431-445 | DAFKLPPMETEEPQI (SEQ ID NO: 193) | 1743.84 | 1744.17 | 0.33 | 86.4 | 11.8% |
| D28d | 431-444 | DAFKLPPMETEEPQ (SEQ ID NO: 194) | 1630.70 | 1631.07 | 0.32 | 74.15 | 56.1% |
| D28e | 431-443 | DAFKLPPMETEEP (SEQ ID NO: 195) | 1502.70 | 1502.98 | 0.28 | 77.36 | 13.6% |
| D28f | 431-442 | DAFKLPPMETEE (SEQ ID NO: 196) | 1405.64 | ND | N/A | N/A | 0.0% |

TABLE 30

Analysis of C-terminal fragments from Lot HUB0701EB

| Fragment | Amino acid position (relative to SEQ ID NO: 122) | Sequence | Theor. mass | Exp. Mass | Error | Elution time | Abundance |
|---|---|---|---|---|---|---|---|
| D28a | 431-447 | DAFKLPPMETEEPQIFY (SEQ ID NO: 191) | 2053.97 | 2054.42 | 0.45 | 99.89 | 1.9% |
| D28b | 431-446 | DAFKLPPMETEEPQIF (SEQ ID NO: 192) | 1890.91 | 1891.36 | 0.45 | 96.92 | 46.7% |
| D28c | 431-445 | DAFKLPPMETEEPQI (SEQ ID NO: 193) | 1743.84 | 1744.24 | 0.40 | 85.98 | 16.7% |
| D28d | 431-444 | DAFKLPPMETEEPQ (SEQ ID NO: 194) | 1630.70 | 1631.14 | 0.39 | 73.9 | 27.8% |
| D28e | 431-443 | DAFKLPPMETEEP (SEQ ID NO: 195) | 1502.70 | 1503.03 | 0.33 | 77.02 | 6.9% |
| D28f | 431-442 | DAFKLPPMETEE (SEQ ID NO: 196) | 1405.64 | ND | N/A | N/A | 0.0% |

Since modifications will be apparent to those of skill in this art, it is intended that this invention be limited only by the scope of the appended claims.

SEQUENCE LISTING (215 sequences)

SEQ ID NO: 1 - DNA, 1530 bp, Homo sapiens
  Human PH20 cDNA encoding amino acids 1-509
atgggagtgctaaaattcaagcacatctttttcagaagctttgttaaatcaagtggagtatcccagatagttttcaccttccttctgattccatgttgcttgactctgaatttcagagcacctcctgttattccaaatgtgcctttcctctgggcctggaatgccccaagtgaattttgtcttggaaaatttgatgagccactagatatgagcctcttctctttcataggaagcccccgaataaacgccaccgggcaaggtgttacaatattttatgttgatagacttggctactatccttacatagattcaatcacaggagtaactgtgaatggaggaatcccccagaagatttccttacaagaccatctggacaaagctaagaaagacattacattttatatgccagtagacaatttgggaatggctgttattgactgggaagaatggagacccacttgggcaagaaactggaaacctaaagatgtttacaagaataggtctattgaattggttcagcaacaaaatgtacaacttagtctcacagaggccactgagaaagcaaaacaagaatttgaaaaggcagggaaggatttcctggtagagactataaaattgggaaaattacttcggccaaatcacttgtggggttattatctttttccggattgttacaaccatcactataagaaacccggttacaatggaagttgcttcaatgtagaaataaaaagaaatgatgatctcagctggttgtggaatgaaagcactgctctttacccatccatttatttgaacactcagcagtctcctgtagctgctacactctatgtgcgcaatcgagttcgggaagccatcagagtttccaaaatacctgatgcaaaaagtccacttccggtttttgcatatacccgcatagtttttactgatcaagttttgaaattcctttctcaagatgaacttgtgtatacatttggcgaaactgttgctctgggtgcttctggaattgtaatatggggaaccctcagtataatgcgaagtatgaaatcttgcttgctcctagacaattacatggagactatactgaatccttacataatcaacgtcacactagcagccaaaatgtgtagccaagtgctttgccaggagcaaggagtgtgtataaggaaaaactggaattcaagtgactatcttcacctcaacccagataattttgctattcaacttgagaaaggtggaaagttcacagtacgtggaaaaccgacacttgaagacctggagcaattttctgaaaaattttattgcagctgttatagcaccttgagttgtaaggagaaagctgatgtaaaagacactgatgctgttgatgtgtgtattgctgatggtgtctgtatagatgcttttctaaaacctcccatggagacagaagaacctcaaattttctacaatgcttcaccctccacactatctgccacaatgttcattgttagtattttgtttcttatcatttcttctgtagcgagtttgtaa

SEQ ID NO: 2 - DNA, 1506 bp, Artificial Sequence
  Codon Optimized PH20 with restriction sites
gctagcatggacatgagggtaccagcccagctgttgggccttcttctgctttggctccctggggcaaggggacttaacttcagagctccccctgtaatcccaaacgtccccttcctgtgggcatggaacgcccctagcgaattctgtttggggaaatttgacgaacctctggacatgtctctgttttcttttatcggtagccctcgaatcaacgctaccggacagggggtgacaatcttttacgtggatcgtctgggctattacccttacatcgacagcattactggggtgaccgtgaacggaggcattcctcagaaaatatcactgcaggaccacctggacaaagctaagaaggatattacattctacatgccagtggacaatctcggaatggctgtgattgactgggaggagtggagacctacttgggcccgaaattggaagcccaaggatgtgtataagaaccgatccattgagctggtgcagcagcagaacgtgcagctgtcccttacagaagccaccgaaaaagctaagcaggaattcgagaaagctgggaaggatttcctggttgagacaataaaacttgggaaactgcttagacctaaccacctctggggctattatttgttccccgattgctacaatcaccactataagaagcccggctacaacggatcttgtttcaacgtcgaaattaaaagaaacgatgacctctcttggttgtggaatgagtctactgcactctacccctctatatatctcaacacacagcagtccccagtagccgctaccctctacgttcggaatagagtgagggaagccatcagggtgtccaagatccccgatgccaaatctcccctcccagtgtttgcctacaccaggatcgtgtttaccgaccaggtgttgaagttcctgagccaggacgagctcgtgtatacttttggcgagacagttgctctgggagcctctgggatcgtgatctggggcactctgagtattatgcgatcaatgaagtcctgcctgctgttggataactacatggagacaatcctgaacccatatatcattaacgtgactttggccgctaagatgtgttcacaggtgctgtgtcaagagcagggagtatgcattaggaagaactggaactcaagcgattatctccatctgaacccagataattttgcaatccagctggaaaagggtggtaaattcactgtccgagggaagcccacactcgaggatctcgaacagtttagtgaaaagttctactgtagctgctatagcactctgagttgtaaggaaaaagccgatgtgaaagacactgatgccgttgacgtttgcatcgccgatggggtgtgtattgacgcctttctcaagccaccaatggagactgaggagccccagatcttttacaacgcctccccctccaccttgagtgctaccatgttcatcgtatctatacttttcctgattatatcaagcgtggcaagcctctgataaggatcc

SEQ ID NO: 3 - protein, 507 aa, Homo sapiens
  HuPH20 precursor 1-507
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPSTLSATMFIVSILFLIISSVA

SEQ ID NO: 4 - protein, 505 aa, Homo sapiens
  HuPH20 precursor 1-505
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPSTLSATMFIVSILFLIISS

SEQ ID NO: 5 - protein, 503 aa, Homo sapiens
  HuPH20 precursor 1-503
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPSTLSATMFIVSILFLII

SEQ ID NO: 6 - protein, 501 aa, Homo sapiens
  HuPH20 precursor 1-501
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPSTLSATMFIVSILFL

SEQ ID NO: 7 - protein, 499 aa, Homo sapiens
  HuPH20 precursor 1-499
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPSTLSATMFIVSIL

SEQ ID NO: 8 - protein, 497 aa, Homo sapiens
  HuPH20 precursor 1-497
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPSTLSATMFIVS

SEQ ID NO: 9 - protein, 495 aa, Homo sapiens
  HuPH20 precursor 1-495
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPSTLSATMFI

SEQ ID NO: 10 - protein, 493 aa, Homo sapiens
  HuPH20 precursor 1-493
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPSTLSATM

SEQ ID NO: 11 - protein, 491 aa, Homo sapiens
  HuPH20 precursor 1-491
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPSTLSA

SEQ ID NO: 12 - protein, 489 aa, Homo sapiens
  HuPH20 precursor 1-489
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPSTL

SEQ ID NO: 13 - protein, 490 aa, Homo sapiens
  HuPH20 precursor 1-490
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPSTLS

SEQ ID NO: 14 - protein, 487 aa, Homo sapiens
  HuPH20 precursor 1-487
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPS

SEQ ID NO: 15 - protein, 485 aa, Homo sapiens
  HuPH20 precursor 1-485
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNAS

SEQ ID NO: 16 - protein, 484 aa, Homo sapiens
  HuPH20 precursor 1-484
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNA

SEQ ID NO: 17 - protein, 483 aa, Homo sapiens
  HuPH20 precursor 1-483
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYN

SEQ ID NO: 18 - protein, 482 aa, Homo sapiens
  HuPH20 precursor 1-482
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 19 - protein, 481 aa, Homo sapiens
  HuPH20 precursor 1-481
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIF

SEQ ID NO: 20 - protein, 480 aa, Homo sapiens
  HuPH20 precursor 1-480
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQI

SEQ ID NO: 21 - protein, 479 aa, Homo sapiens
  HuPH20 precursor 1-479
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQ

SEQ ID NO: 22 - protein, 478 aa, Homo sapiens
  HuPH20 precursor 1-478
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEP

SEQ ID NO: 23 - protein, 477 aa, Homo sapiens
  HuPH20 precursor 1-477
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEE

SEQ ID NO: 24 - protein, 476 aa, Homo sapiens
  HuPH20 precursor 1-476
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETE

SEQ ID NO: 25 - protein, 475 aa, Homo sapiens
  HuPH20 precursor 1-475
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMET

SEQ ID NO: 26 - protein, 474 aa, Homo sapiens
  HuPH20 precursor 1-474
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPME

SEQ ID NO: 27 - protein, 473 aa, Homo sapiens
  HuPH20 precursor 1-473
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPM

SEQ ID NO: 28 - protein, 472 aa, Homo sapiens
  HuPH20 precursor 1-472
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPP

SEQ ID NO: 29 - protein, 471 aa, Homo sapiens
  HuPH20 precursor 1-471
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKP

SEQ ID NO: 30 - protein, 470 aa, Homo sapiens
  HuPH20 precursor 1-470
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLK

SEQ ID NO: 31 - protein, 469 aa, Homo sapiens
  HuPH20 precursor 1-469
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFL

SEQ ID NO: 32 - protein, 468 aa, Homo sapiens
  HuPH20 precursor 1-468
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAF

SEQ ID NO: 33 - protein, 467 aa, Homo sapiens
  HuPH20 precursor 1-467
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDA

SEQ ID NO: 34 - protein, 466 aa, Homo sapiens
  HuPH20 precursor 1-466
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCID

SEQ ID NO: 35 - protein, 465 aa, Homo sapiens
  HuPH20 precursor 1-465
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCI

SEQ ID NO: 36 - protein, 464 aa, Homo sapiens
  HuPH20 precursor 1-464
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVC

SEQ ID NO: 37 - protein, 462 aa, Homo sapiens
  HuPH20 precursor 1-462
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADG

SEQ ID NO: 38 - protein, 460 aa, Homo sapiens
  HuPH20 precursor 1-460
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIA

SEQ ID NO: 39 - protein, 458 aa, Homo sapiens
  HuPH20 precursor 1-458
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVC

SEQ ID NO: 40 - protein, 456 aa, Homo sapiens
  HuPH20 precursor 1-456
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVD

SEQ ID NO: 41 - protein, 454 aa, Homo sapiens
  HuPH20 precursor 1-454
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDA

SEQ ID NO: 42 - protein, 452 aa, Homo sapiens
  HuPH20 precursor 1-452
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDT

SEQ ID NO: 43 - protein, 450 aa, Homo sapiens
  HuPH20 precursor 1-450
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVK

SEQ ID NO: 44 - protein, 508 aa, Homo sapiens
  HuPH20 precursor 1-508
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPSTLSATMFIVSILFLIISSVAS

SEQ ID NO: 45 - protein, 506 aa, Homo sapiens
  HuPH20 precursor 1-506
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPSTLSATMFIVSILFLIISSV

SEQ ID NO: 46 - protein, 504 aa, Homo sapiens
  HuPH20 precursor 1-504
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPSTLSATMFIVSILFLIIS

SEQ ID NO: 47 - protein, 502 aa, Homo sapiens
  HuPH20 precursor 1-502
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPSTLSATMFIVSILFLI

SEQ ID NO: 48 - protein, 500 aa, Homo sapiens
  HuPH20 precursor 1-500
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPSTLSATMFIVSILF

SEQ ID NO: 49 - protein, 498 aa, Homo sapiens
  HuPH20 precursor 1-498
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPSTLSATMFIVSI

SEQ ID NO: 50 - protein, 496 aa, Homo sapiens
  HuPH20 precursor 1-496
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPSTLSATMFIV

SEQ ID NO: 51 - protein, 494 aa, Homo sapiens
  HuPH20 precursor 1-494
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPSTLSATMF

SEQ ID NO: 52 - protein, 492 aa, Homo sapiens
  HuPH20 precursor 1-492
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPSTLSAT

SEQ ID NO: 53 - protein, 488 aa, Homo sapiens
  HuPH20 precursor 1-488
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPST

SEQ ID NO: 54 - protein, 486 aa, Homo sapiens
  HuPH20 precursor 1-486
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASP

SEQ ID NO: 55 - protein, 472 aa, Homo sapiens
  mature HuPH20 36-507
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPSTLSATMFIVSILFLIISSVA

SEQ ID NO: 56 - protein, 470 aa, Homo sapiens
  mature HuPH20 36-505
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPSTLSATMFIVSILFLIISS

SEQ ID NO: 57 - protein, 468 aa, Homo sapiens
  mature HuPH20 36-503
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPSTLSATMFIVSILFLII

SEQ ID NO: 58 - protein, 466 aa, Homo sapiens
  mature HuPH20 36-501
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPSTLSATMFIVSILFL

SEQ ID NO: 59 - protein, 464 aa, Homo sapiens
  mature HuPH20 36-499
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPSTLSATMFIVSIL

SEQ ID NO: 60 - protein, 462 aa, Homo sapiens
  esHuPH20 36-497
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPSTLSATMFIVS

SEQ ID NO: 61 - protein, 460 aa, Homo sapiens
  esHuPH20 36-495
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPSTLSATMFI

SEQ ID NO: 62 - protein, 458 aa, Homo sapiens
  esHuPH20 36-493
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPSTLSATM

SEQ ID NO: 63 - protein, 456 aa, Homo sapiens
  esHuPH20 36-491
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPSTLSA

SEQ ID NO: 64 - protein, 454 aa, Homo sapiens
  mature HuPH20 36-489
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPSTL

SEQ ID NO: 65 - protein, 455 aa, Homo sapiens
  mature HuPH20 36-490
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPSTLS

SEQ ID NO: 66 - protein, 452 aa, Homo sapiens
  mature HuPH20 36-487
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPS

SEQ ID NO: 67 - protein, 450 aa, Homo sapiens
  mature HuPH20 36-485
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNAS

SEQ ID NO: 68 - protein, 449 aa, Homo sapiens
  Mature HuPH20 36-484
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNA

SEQ ID NO: 69 - protein, 448 aa, Homo sapiens
  Mature HuPH20 36-483
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYN

SEQ ID NO: 70 - protein, 447 aa, Homo sapiens [sequence omitted]

SEQ ID NO: 71 - protein, 446 aa, Homo sapiens
  Mature HuPH20 36-481
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIF

SEQ ID NO: 72 - protein, 445 aa, Homo sapiens
  Mature HuPH20 36-480
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQI

SEQ ID NO: 73 - protein, 479 aa, Homo sapiens; identical to SEQ ID NO: 21
  Mature HuPH20 36-479

SEQ ID NO: 74 - protein, 443 aa, Homo sapiens
  Mature HuPH20 36-478
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEP

SEQ ID NO: 75 - protein, 442 aa, Homo sapiens
  Mature HuPH20 36-477
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEE

SEQ ID NO: 76 - protein, 441 aa, Homo sapiens
  Mature HuPH20 36-476
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETE

SEQ ID NO: 77 - protein, 440 aa, Homo sapiens
  Mature HuPH20 36-475
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMET

SEQ ID NO: 78 - protein, 439 aa, Homo sapiens
  Mature HuPH20 36-474
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPME

SEQ ID NO: 79 - protein, 438 aa, Homo sapiens
  Mature HuPH20 36-473
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPM

SEQ ID NO: 80 - protein, 437 aa, Homo sapiens
  Mature HuPH20 36-472
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPP

SEQ ID NO: 81 - protein, 436 aa, Homo sapiens
  Mature HuPH20 36-471
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKP

SEQ ID NO: 82 - protein, 435 aa, Homo sapiens
  Mature HuPH20 36-470
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLK

SEQ ID NO: 83 - protein, 434 aa, Homo sapiens
  Mature HuPH20 36-469
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFL

SEQ ID NO: 84 - protein, 433 aa, Homo sapiens
  Mature HuPH20 36-468
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAF

SEQ ID NO: 85 - protein, 432 aa, Homo sapiens
  Mature HuPH20 36-467
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDA

SEQ ID NO: 86 - protein, 431 aa, Homo sapiens
  Mature HuPH20 36-466
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCID

SEQ ID NO: 87 - protein, 430 aa, Homo sapiens
  Mature HuPH20 36-465
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCI

SEQ ID NO: 88 - protein, 429 aa, Homo sapiens
  Mature HuPH20 36-464
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVC

SEQ ID NO: 89 - protein, 427 aa, Homo sapiens
  Mature HuPH20 36-462
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADG

SEQ ID NO: 90 - protein, 425 aa, Homo sapiens
  Mature HuPH20 36-460
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIA

SEQ ID NO: 91 - protein, 423 aa, Homo sapiens
  Mature HuPH20 36-458
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVC

SEQ ID NO: 92 - protein, 421 aa, Homo sapiens
  Mature HuPH20 36-456
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVD

SEQ ID NO: 93 - protein, 419 aa, Homo sapiens
  Mature HuPH20 36-454
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDA

SEQ ID NO: 94 - protein, 417 aa, Homo sapiens
  Mature HuPH20 36-452
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDT

SEQ ID NO: 95 - protein, 415 aa, Homo sapiens
  Mature HuPH20 36-450
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVK

SEQ ID NO: 96 - protein, 473 aa, Homo sapiens
  Mature HuPH20 36-508
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPSTLSATMFIVSILFLIISSVAS

SEQ ID NO: 97 - protein, 471 aa, Homo sapiens
  Mature HuPH20 36-506
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPSTLSATMFIVSILFLIISSV

SEQ ID NO: 98 - protein, 469 aa, Homo sapiens
  Mature HuPH20 36-504
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPSTLSATMFIVSILFLIIS

SEQ ID NO: 99 - protein, 467 aa, Homo sapiens
  Mature HuPH20 36-502
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPSTLSATMFIVSILFLI

SEQ ID NO: 100 - protein, 465 aa, Homo sapiens
  Mature HuPH20 36-500
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPSTLSATMFIVSILF

SEQ ID NO: 101 - protein, 463 aa, Homo sapiens
  Mature HuPH20 36-498
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPSTLSATMFIVSI

SEQ ID NO: 102 - protein, 461 aa, Homo sapiens
  esHuPH20 36-496
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPSTLSATMFIV

SEQ ID NO: 103 - protein, 459 aa, Homo sapiens
  esHuPH20 36-494
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPSTLSATMF

SEQ ID NO: 104 - protein, 457 aa, Homo sapiens
  esHuPH20 36-492
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPSTLSAT

SEQ ID NO: 105 - protein, 453 aa, Homo sapiens
  Mature HuPH20 36-488
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPST

SEQ ID NO: 106 - protein, 451 aa, Homo sapiens
  Mature HuPH20 36-486
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASP

SEQ ID NO: 107 - protein, 509 aa, Homo sapiens
  Human PH20 1-509
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPSTLSATMFIVSILFLIISSVASL

SEQ ID NO: 108 - protein, 474 aa, Homo sapiens
  Mature Human PH20 36-509
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPSTLSATMFIVSILFLIISSVASL

SEQ ID NO: 109 - protein, 482 aa, Homo sapiens; identical to SEQ ID NO: 18
  Precursor rHuPH20 1-482

SEQ ID NO: 110 - DNA, 1446 bp, Homo sapiens
  DNA encoding souble rHuPH20 precursor
atgggagtgctaaaattcaagcacatctttttcagaagctttgttaaatcaagtggagtatcccagatagttttcaccttccttctgattccatgttgcttgactctgaatttcagagcacctcctgttattccaaatgtgcctttcctctgggcctggaatgccccaagtgaattttgtcttggaaaatttgatgagccactagatatgagcctcttctctttcataggaagcccccgaataaacgccaccgggcaaggtgttacaatattttatgttgatagacttggctactatccttacatagattcaatcacaggagtaactgtgaatggaggaatcccccagaagatttccttacaagaccatctggacaaagctaagaaagacattacattttatatgccagtagacaatttgggaatggctgttattgactgggaagaatggagacccacttgggcaagaaactggaaacctaaagatgtttacaagaataggtctattgaattggttcagcaacaaaatgtacaacttagtctcacagaggccactgagaaagcaaaacaagaatttgaaaaggcagggaaggatttcctggtagagactataaaattgggaaaattacttcggccaaatcacttgtggggttattatctttttccggattgttacaaccatcactataagaaacccggttacaatggaagttgcttcaatgtagaaataaaaagaaatgatgatctcagctggttgtggaatgaaagcactgctctttacccatccatttatttgaacactcagcagtctcctgtagctgctacactctatgtgcgcaatcgagttcgggaagccatcagagtttccaaaatacctgatgcaaaaagtccacttccggtttttgcatatacccgcatagtttttactgatcaagttttgaaattcctttctcaagatgaacttgtgtatacatttggcgaaactgttgctctgggtgcttctggaattgtaatatggggaaccctcagtataatgcgaagtatgaaatcttgcttgctcctagacaattacatggagactatactgaatccttacataatcaacgtcacactagcagccaaaatgtgtagccaagtgctttgccaggagcaaggagtgtgtataaggaaaaactggaattcaagtgactatcttcacctcaacccagataattttgctattcaacttgagaaaggtggaaagttcacagtacgtggaaaaccgacacttgaagacctggagcaattttctgaaaaattttattgcagctgttatagcaccttgagttgtaaggagaaagctgatgtaaaagacactgatgctgttgatgtgtgtattgctgatggtgtctgtatagatgcttttctaaaacctcccatggagacagaagaacctcaaattttctac

SEQ ID NO: 111 - protein, 553 aa, Bos taurus
  Bovine PH20
MRMLRRHHISFRSFAGSSGTPQAVFTFLLLPCCLALDFRAPPLISNTSFLWAWNAPVERCVNRRFQLPPDLRLFSVKGSPQKSATGQFITLFYADRLGYYPHIDEKTGKTVFGGIPQLGNLKSHMEKAKNDIAYYIPNDSVGLAVIDWENWRPTWARNWKPKDVYRDESVELVLQKNPQLSFPEASKIAKVDFETAGKSFMQETLKLGKLLRPNHLWGYYLFPDCYNHNHNQPTYNGNCPDVEKRRNDDLEWLWKESTALFPSVYLNIRLKSTQNAALYVRNRVQEAIRLSKIASVESPLPVFVYARPVFTDGSSTYLSQGDLVNSVGEIVSLGASGIIMWGSLNLSLSMQSCMNLGTYLNTTLNPYIINVTLAAKMCSQVLCHNEGVCTRKHWNSSDYLHLNPMNFAIQTGEGGKYTVPGTVTLEDLQKFSDTFYCSCYANIHCKKRVDIKNVHSVNVCMAEDICIDSPVKLQPSDHSSSQEASTTTFSSISPSTTTATVSPCTPEKHSPECLKVRCSEVIPNVTQKACQSVKLKNISYQSPIQNIKNQTTY

SEQ ID NO: 112 - protein, 545 aa, Oryctolagus cuniculus
  Rabbit PH20
MGVLKFKHIFFGSAVELSGVFQIVFIFLLIPCCLTANFRAPPVIPNVPFLWAWNAPTEFCLGKSGEPLDMSLFSLFGSPRKNKTGQGITIFYVDRLGYYPYIDPHTGAIVHGRIPQLGPLQQHLTKLRQEILYYMPKDNVGLAVIDWEEWLPTWLRNWKPKDIYRIKSIELVKSQHPQYNHSYATEKAKRDFEKAGKDFMEETLKLGRLLRPNHLWGYYLFPDCYNHHYDKPNLYKGSCFDIEKKRNDDLSWLWKESTALFPSVYLTSRARSATALSKLYVVRNRVHEAIRVSKIPDDKSPLPNFVYTRLVFTDQIFQFLSHHDLVYTIGEIVALGASGIVVWGSQSLARSMKSCLHLDNYMKTILNPYLINVTLAAKMCNQVLCQEQGVCTRKNWNPNDYLHLNPGNFAIQLGSNGTYKVDGKPTLTDLEQFSKNFQCSCYTNLNCKERTDMNNVRTVNVCAVENVCIDTNVGPQAVTYAPKEKKDVAHILSNTTSINSSTTMSLPFPRKHVSGCLLVLCMYSQYLNICYRLVAIGIQHGYYLK

SEQ ID NO: 113 - protein, 114 aa, Ovis aries
  Sheep PH20 (partial)
LYVRNRVREAIRLSKIASVESPLPVFVYHRPVFTDGSSTYLSQGDLVNSVGEIVALGASGIIMWGSLNLSLTMQSCMNLGNYLNTTLNPYIINVTLAAKMCSQVLCQEQGVCIR

SEQ ID NO: 114 - protein, 510 aa, Macaca fascicularis
  Cynomolgus monkey PH20
MGVLKFKHIFFRSFVKSSGVSQIVFTFLLIPCCLTLNFRAPPIIPNVPFLWAWNAPSEFCLGKFNEPLDMSLFTLMGSPRINVTGQGVTIFYVDRLGYYPYIDLTTGVTVHGGIPQKVSLQDHLDKSKQDILFYMPVDNLGMAVIDWEEWRPTWARNWKPKDVYKNRSIELVQQQNVQLSLPQATDKAKQEFEKAGKDFMLETIKLGRSLRPNHLWGYYLFPDCYNHHYRKPGYNGSCFDVEIKRNDDLSWLWNESTALYPSIYLNTQQSVVVATLYVRNRVREAIRVSKIPDAKNPLPVFVYARLVFTDQVLKFLSREELVSTLGETVALGASGIVIWGSLSITRSMKSCLLLDTYMETILNPYIINVTLAAKMCSQVLCQEQGVCIRKDWNSSDYLHLNPDNFDIRLEKGGKFTVHGKPTVEDLEEFSEKFYCSCYTNLSCKEKADVKDTDAVDVCIADGVCIDASLKPPVETEGSPPIFYNTSSSTVSTTMFIVNILFLIISSVASL

SEQ ID NO: 115 - protein, 529 aa, Cavia porcellus
  Guinea Pig PH20
MGAFTFKHSFFGSFVECSGVLQTVFIFLLIPCCLADKRAPPLIPNVPLLWVWNAPTEFCIGGTNQPLDMSFFSIVGTPRKNITGQSITLYYVDRLGYYPYIDPHTGAIVHGGLPQLMNLQQHLRKSRQDILFYMPTDSVGLAVIDWEEWRPTWTRNWRPKDIYRNKSIELVKSQHPQYNHSYAVAVAKRDFERTGKAFMLETLKLGKSLRPSSLWGYYLFPDCYNTHFTKPNYDGHCPPIELQRNNDLQWLWNDSTALYPSVYLTSRVRSSQNGALYVRNRVHESIRVSKLMDDKNPLPIYVYIRLVFTDQTTTFLELDDLVHSVGEIVPLGVSGIIIWGSLSLTRSLVSCIGLENYMKGTLLPYLINVTLAAKMCGQVLCKNQGICTRKDWNTNTYLHLNATNFDIELQQNGKFVVHGKPSLEDLQEFSKNFHCSCYTNVACKDRLDVHNVRSVNVCTANNICIDAVLNFPSLDDDDEPPITDDTSQNQDSISDITSSAPPSSHILPKDLSWCLFLLSIFSQHWKYLL

SEQ ID NO: 116 - protein, 512 aa, Rattus norvegicus
  Rat PH20
MGELQFKWLFWRSFAESGGTFQTVLIFLFIPYSLTVDYRATPVLSDTTFVWVWNVPTEACVENVTEPIDLSFFSLIGSPRKTAIGQPVTLFYVDRLGNYPHIDAQQTEHHGGIPQKGDLTTHLVKAKEDVERYIPTDKLGLAIIDWEEWRPTWMRNWTPKDIYRNKSIELVQAADPAINITEATVRAKAQFEGAAKEFMEGTLKLGKHIRPKHLWGFYLFPDCYNNKFQVDNYDGQCPDVEKKRNDDLDWLWKESTGLYPSVYLKKDLKSSRKATLYVRYRVLESIRVSKVSDESNPVPIFVYIRLVFTDHVSEYLLEDDLVNTIGEIVAQGTSGIIIWDAMSLAQRSAGCPILRQYMKTTLNPYIVNVTLAAKMCSQTLCKEKGMCSRKTESSDAYLHLDPSSFSINVTEAGKYEVLGKPEVKDLEYFSEHFKCSCFSKMTCEETSDMRSIQDVNVCMGDNVCIKATLGPNSAFHLLPGKGLLLMTTLAHILHHLPHDIFVFPWKMLVSTP

SEQ ID NO: 117 - protein, 512 aa, Mus musculus
  Mouse PH20
MGELRFKHLFWGSFVESGGTFQTVLIFLLIPCSLTVDYRAAPILSNTTFLWIWNVPTERCVGNVNDPIDLSFFSLIGSPRKTATGQPVTLFYVDRLGLYPHIDANQAEHYGGIPQRGDYQAHLRKAKTDIEHYIPDDKLGLAIIDWEEWRPTWLRNWKPKDNYRNKSIELVQSTNPGLSITEATQKAIQQFEEAGRKFMEGTLHLGKFLRPNQLWGYYLFPDCYNNKFQDPKYDGQCPAVEKKRNDNLKWLWKASTGLYPSVYLKKDLKSNRQATLYVRYRVVEAIRVSKVGNASDPVPIFVYIRLVFTDRTSEYLLEDDLVNTIGEIVALGTSGIIIWDAMSLAQRAAGCPILHKYMQTTLNPYIVNVTLAAKMCSQTLCNEKGMCSRRKESSDVYLHLNPSHFDIMLTETGKYEVLGNPRVGDLEYFSEHFKCSCFSRMTCKETSDVKNVQDVNVCVGDNVCIKAKVEPNPAFYLLPGKSLLFMTTLGHVLYHLPQDIFVFPRKTLVSTP

SEQ ID NO: 118 - protein, 520 aa, Ovis aries
  Sheep PH20
LDFPAPPLISNTSFLWAWNAPAERCVKIFKLPPDLRLFSVKGSPQKSATGQFITLFYADRLGYYPHIDEKTGNTVYGGIPQLGNLKNHLEKAKKDIAYYIPNDSVGLAVIDWENWRPTWARNWKPKDVYRDESVELVLQKNPQLSFPEASKIAKVDFETAGKSFMQETLKLGKLLRPNHLWGYYLFPDCYNHNYNQPTYNGNCSDLEKRRNDDLDWLWKESTALFPSVYLNIKLKSTPKAAFYVRNRVQEAIRLSKIASVESPLPVFVYHRPVFTDGSSTYLSQGDLVNSVGEIVALGASGIIMWGSLNLSLTMQSCMNLGNYNTTLNPYIINVTLAAKMCSQVLCHDEGVCTRKQWNSSDYLHLNPIMNFAIQTGKGGKYTVPGKVTLEDLQTFSDKFYCSCYANINCKKRVDIKNVHSVNVCMAEDICIEGPVKLQPSDHSSSQNEASTTTVSSISPSTTATTVVSPCTPEKQSPECLKVRCLEAIANVTQTGCQGVKWKNTSSQSQSSIQNIKNQTT

SEQ ID NO: 119 - protein, 474 aa, Bos taurus
  Cow PH20
MGMFRRHHISFRSFAGSSGTPQAVFTFLLLPCCLALDFRAPPLISNTSFLWAWNAPVERCVNRRFQLPPDLRLFSVKGSPQKSATGQFITLFYADRLGYYPHIDEKTGKTVFGGIPQLGNLKSHLEKAKNDIAYYIPNDSVGLAVIDWENWRPTWARNWKPKDVYRDESVELVLQKNPQLSFPEASKIAKVDFETAGKSFMQETLKLGKLLRPNHLWGYYLFPDCYNHNHNQPTYNGNCPDVEKRRNDDLEWLWKESTALFPSVYLNIRLKSTQNAALYVRNRVQEAIRLSKIASVESPLPVFVYARPVFTDGSSTYLSQGDLVNSVGEIVSLGASGIIMWGSLNLSLSVQSCMNLGTYLNTTLNPYIINVTLAAKMCSQVLCHDGGVCTRKHWNSSDYLHLNPMNFAIQTGEGGKYTVPGTLTLEDLQKFSDTFYCSCYSNLSCKKRVDIKNVHSVDVCMAEDVCIDAFLKPP

SEQ ID NO: 120 - protein, 517 aa, Ovis aries
  Sheep PH20 (Halozyme)
DFRAPPLISNTSFLWAWNAPAERCIKIFKLPPDLRLFSVKGSPQKSATGQFITLFYADRLGYYPHIDEKTGNTVYGGIPQLGNLKNHLEKAKKDIAYYIPNDSVGLAVIDWENWRPTWARNWKPKDVYRDESVELVLQKNPQLSFPEASKIAKVDFETAGKSFMQETLKLGKLLRPNHLWGYYLFPDCYNHNYNQPTYNGNCSDLEKRRNDDLDWLWKESTALFPSVYLNIKLKSTPKAAFYVRNRVQEAIRLSKIASVESPLPVFVYHRPVFTDGSSTYLSQGDLVNSVGEIVALGASGIIMWGSLNLSLTMQSCMNLGNYLNTTLNPYIINVTLAAKMCSQVLCHDEGVCTRKQWNSSDYLHLNPMNFAIQTGKGGKYTVPGKVTLEDLQTFSDKFYCSCYANINCKKRVDIKNVHSVNVCMAEDICIEGPVKLQPSDHSSSQNEASTTTVSSISPSTTATTVSPCTPEKQSPECLKVRCLEAIANVTQTGCQGVKWKNTSSQSSIQNIKNQTTY

SEQ ID NO: 121 - DNA, 1620 bp, Ovis aries
  DNA encoding sheep PH20 in SEQ ID NO:118
ttttccgtgttggttggctctggacttcagagcaccccctctcatttcaaacacttctttcctctgggcctggaatgccccagctgaacgttgtattaaaatctttaaactacctccagatctgagactcttctctgtaaaaggaagcccccaaaaaagtgctacgggacaatttattacattattttatgctgatagacttggctactatcctcatatagatgaaaaaacaggcaacactgtatatggaggaattccccagttgggaaacttaaaaaatcatttggaaaaagccaaaaaagacattgcctattacataccaaatgacagcgtgggcttggcggtcattgactgggaaaactggaggcctacctgggcaagaaactggaaacctaaagatgtttacagggatgagtctgttgagttggttctgcaaaaaaatccacaactcagtttcccagaggcttccaagattgcaaaagtggattttgagacagcaggaaagagtttcatgcaagagactttaaaactgggaaaattacttcggccaaatcacttatggggttattatctttttcctgattgttacaatcataattataaccagcctacttacaatggaaattgctctgatttagaaaaaaggagaaatgatgatctcgactggttgtggaaggaaagcactgcccttttcccttctgtttatttgaatatcaagttaaaatctactccaaaagctgccttctatgttcgtaatcgtgtccaggaagccattcggttgtctaaaatagcgagtgttgaaagtccacttcccgtttttgtatatcaccgtccagtttttactgatgggtcttcaacatacctttctcagggtgaccttgtgaattcggttggtgagatcgttgctctaggtgcctctgggattataatgtggggcagtctcaatctaagcctaactatgcaatcttgcatgaacctaggcaattacttgaacactacactgaatccttacataatcaacgtcaccctagcagccaaaatgtgcagccaagtgctttgccacgatgaaggagtgtgtacaaggaaacaatggaattcaagcgactatcttcacctgaacccaatgaattttgctattcaaactgggaaaggtggaaaatacacagtacctgggaaagtcacacttgaagacctgcaaacgttttctgataaattttattgcagttgttatgccaacatcaactgtaagaagagagttgatataaaaaatgttcatagtgttaatgtatgtatggcagaagacatttgtatagagggccctgtgaagttacaacccagtgatcattcctctagccagaatgaggcatctactaccaccgtcagcagtatctcaccctctactacagccaccacagtatctccatgtactcctgagaaacagtcccctgagtgcctcaaagtcaggtgtttggaagccatcgccaacgtcacccaaacggggtgtcaaggtgttaaatggaagaacacttccagtcagtcaagtattcaaaatattaaaaatcaaacaacctattaaaatataaattcagtgcttataaaaaaaaaaaaaaaaaaaaaaaa

SEQ ID NO: 122 - protein, 447 aa, Homo sapiens [sequence omitted]

SEQ ID NO: 123 - protein, 446 aa, Homo sapiens; identical to SEQ ID NO: 71
  soluble rHuPH20 36-481

SEQ ID NO: 124 - protein, 445 aa, Homo sapiens; identical to SEQ ID NO: 72
  soluble rHuPH20 36-480

SEQ ID NO: 125 - protein, 444 aa, Homo sapiens
  soluble rHuPh20 36-479
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQ

SEQ ID NO: 126 - protein, 443 aa, Homo sapiens; identical to SEQ ID NO: 74
  soluble rHuPH20 36-478

SEQ ID NO: 127 - protein, 442 aa, Homo sapiens; identical to SEQ ID NO: 75
  soluble rHuPh20 36-477

SEQ ID NO: 128 - protein, 467 aa, Homo sapiens; identical to SEQ ID NO: 33
  sHuPH20 precursor 1-467

SEQ ID NO: 129 - protein, 477 aa, Homo sapiens; identical to SEQ ID NO: 23
  sHuPH20 precursor 1-477

SEQ ID NO: 130 - protein, 478 aa, Homo sapiens; identical to SEQ ID NO: 22
  sHuPH20 precursor 1-478

SEQ ID NO: 131 - protein, 479 aa, Homo sapiens; identical to SEQ ID NO: 21
  sHuPH20 precursor 1-479

SEQ ID NO: 132 - protein, 480 aa, Homo sapiens; identical to SEQ ID NO: 20
  sHuPH20 precursor 1-480

SEQ ID NO: 133 - protein, 481 aa, Homo sapiens; identical to SEQ ID NO: 19
  sHuPH20 precursor 1-481

SEQ ID NO: 134 - protein, 483 aa, Homo sapiens; identical to SEQ ID NO: 17
  sHuPH20 precursor 1-483

SEQ ID NO: 135 - protein, 432 aa, Homo sapiens; identical to SEQ ID NO: 85
  sHuPH20 mature 36-467

SEQ ID NO: 136 - protein, 448 aa, Homo sapiens; identical to SEQ ID NO: 69
  sHuPH20 mature 36-483

SEQ ID NO: 137 - protein, 509 aa, Homo sapiens
  precursor PH20 variant P48A
MGVLKFKHIFFRSFVKSSGVSQIVFTFLLIPCCLTLNFRAPPVIPNVAFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPSTLSATMFIVSILFLIISSVASL

SEQ ID NO: 138 - protein, 509 aa, Homo sapiens
  precursor PH20 variant L499W
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPSTLSATMFIVSIWFLIISSVASL

SEQ ID NO: 139 - DNA, 1449 bp, Homo sapiens
  Gen2 mRNA sequence
atgggagtgctaaaattcaagcacatctttttcagaagctttgttaaatcaagtggagtatcccagatagttttcaccttccttctgattccatgttgcttgactctgaatttcagagcacctcctgttattccaaatgtgcctttcctctgggcctggaatgccccaagtgaattttgtcttggaaaatttgatgagccactagatatgagcctcttctctttcataggaagcccccgaataaacgccaccgggcaaggtgttacaatattttatgttgatagacttggctactatccttacatagattcaatcacaggagtaactgtgaatggaggaatcccccagaagatttccttacaagaccatctggacaaagctaagaaagacattacattttatatgccagtagacaatttgggaatggctgttattgactgggaagaatggagacccacttgggcaagaaactggaaacctaaagatgtttacaagaataggtctattgaattggttcagcaacaaaatgtacaacttagtctcacagaggccactgagaaagcaaaacaagaatttgaaaaggcagggaaggatttcctggtagagactataaaattgggaaaattacttcggccaaatcacttgtggggttattatctttttccggattgttacaaccatcactataagaaacccggttacaatggaagttgcttcaatgtagaaataaaaagaaatgatgatctcagctggttgtggaatgaaagcactgctctttacccatccatttatttgaacactcagcagtctcctgtagctgctacactctatgtgcgcaatcgagttcgggaagccatcagagtttccaaaatacctgatgcaaaaagtccacttccggtttttgcatatacccgcatagtttttactgatcaagttttgaaattcctttctcaagatgaacttgtgtatacatttggcgaaactgttgctctgggtgcttctggaattgtaatatggggaaccctcagtataatgcgaagtatgaaatcttgcttgctcctagacaattacatggagactatactgaatccttacataatcaacgtcacactagcagccaaaatgtgtagtcaagtgctttgccaggagcaaggagtgtgtataaggaaaaactggaattcaagtgactatcttcacctcaacccagataattttgctattcaacttgagaaaggtggaaagttcacagtacgtggaaaaccgacacttgaagacctggagcaattttctgaaaaattttattgcagctgttatagcaccttgagttgtaaggagaaagctgatgtaaaagacactgatgctgttgatgtgtgtattgctgatggtgtctgtatagatgcttttctaaaacctcccatggagacagaagaacctcaaattttctactga

SEQ ID NO: 140 - DNA, 6630 bp, Artificial Sequence
  HZ24 vector
tcaatattggccattagccatattattcattggttatatagcataaatcaatattggctattggccattgcatacgttgtatctatatcataatatgtacatttatattggctcatgtccaatatgaccgccatgttggcattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtccgccccctattgacgtcaatgacggtaaatggcccgcctggcattatgcccagtacatgaccttacgggactttcctacttggcagtacatctacgtattagtcatcgctattaccatggtgatgcggttttggcagtacaccaatgggcgtggatagcggtttgactcacggggatttccaagtctccaccccattgacgtcaatgggagtttgttttggcaccaaaatcaacgggactttccaaaatgtcgtaataaccccgccccgttgacgcaaatgggcggtaggcgtgtacggtgggaggtctatataagcagagctcgtttagtgaaccgtcagatcactagaagctttattgcggtagtttatcacagttaaattgctaacgcagtcagtgcttctgacacaacagtctcgaacttaagctgcagaagttggtcgtgaggcactgggcaggtaagtatcaaggttacaagacaggtttaaggagaccaatagaaactgggcttgtcgagacagagaagactcttgcgtttctgataggcacctattggtcttactgacatccactttgcctttctctccacaggtgtccactcccagttcaattacagctcttaaggctagagtacttaatacgactcactataggctagcatgggagtgctaaaattcaagcacatctttttcagaagctttgttaaatcaagtggagtatcccagatagttttcaccttccttctgattccatgttgcttgactctgaatttcagagcacctcctgttattccaaatgtgcctttcctctgggcctggaatgccccaagtgaattttgtcttggaaaatttgatgagccactagatatgagcctcttctctttcataggaagcccccgaataaacgccaccgggcaaggtgttacaatattttatgttgatagacttggctactatccttacatagattcaatcacaggagtaactgtgaatggaggaatcccccagaagatttccttacaagaccatctggacaaagctaagaaagacattacattttatatgccagtagacaatttgggaatggctgttattgactgggaagaatggagacccacttgggcaagaaactggaaacctaaagatgtttacaagaataggtctattgaattggttcagcaacaaaatgtacaacttagtctcacagaggccactgagaaagcaaaacaagaatttgaaaaggcagggaaggatttcctggtagagactataaaattgggaaaattacttcggccaaatcacttgtggggttattatctttttccggattgttacaaccatcactataagaaacccggttacaatggaagttgcttcaatgtagaaataaaaagaaatgatgatctcagctggttgtggaatgaaagcactgctctttacccatccatttatttgaacactcagcagtctcctgtagctgctacactctatgtgcgcaatcgagttcgggaagccatcagagtttccaaaatacctgatgcaaaaagtccacttccggtttttgcatatacccgcatagtttttactgatcaagttttgaaattcctttctcaagatgaacttgtgtatacatttggcgaaactgttgctctgggtgcttctggaattgtaatatggggaaccctcagtataatgcgaagtatgaaatcttgcttgctcctagacaattacatggagactatactgaatccttacataatcaacgtcacactagcagccaaaatgtgtagccaagtgctttgccaggagcaaggagtgtgtataaggaaaaactggaattcaagtgactatcttcacctcaacccagataattttgctattcaacttgagaaaggtggaaagttcacagtacgtggaaaaccgacacttgaagacctggagcaattttctgaaaaattttattgcagctgttatagcaccttgagttgtaaggagaaagctgatgtaaaagacactgatgctgttgatgtgtgtattgctgatggtgtctgtatagatgcttttctaaaacctcccatggagacagaagaacctcaaattttctactgaggatccatagctaacgcccctctccctcccccccccctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctctcctcaagcgtattcaacaaggggctgaaggatgcccagaaggtaccccattgtatgggatctgatctggggcctcggtgcacatgctttacatgtgtttagtcgaggttaaaaaaacgtctaggccccccgaaccacggggacgtggttttcctttgaaaaacacgatgataagcttgccacaacccacagcggccgctgccatcatggttcgaccattgaactgcatcgtcgccgtgtcccaaaatatggggattggcaagaacggagacctaccctggcctccgctcaggaacgagttcaagtacttccaaagaatgaccacaacctcttcagtggaaggtaaacagaatctggtgattatgggtaggaaaacctggttctccattcctgagaagaatcgacctttaaaggacagaattaatatagttctcagtagagaactcaaagaaccaccacgaggagctcattttcttgccaaaagtttggatgatgccttaagacttattgaacaaccggaattggcaagtaaagtagacatggtttggatagtcggaggcagttctgtttaccaggaagccatgaatcaaccaggccacctcagactctttgtgacaaggatcatgcaggaatttgaaagtgacacgtttttcccagaaattgatttggggaaatataaacttctcccagaatacccaggcgtcctctctgaggtccaggaggaaaaaggcatcaagtataagtttgaagtctacgagaagaaagactaaacgcgtggtacctctagagtcgacccgggcggccgcttcgagcagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggagatgtgggaggttttttaaagcaagtaaaacctctacaaatgtggtaaaatcgataaggatccgggctggcgtaatagcgaagaggcccgcaccgatcgcccttcccaacagttgcgcagcctgaatggcgaatggacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttcctgatgcggtattttctccttacgcatctgtgcggtatttcacaccgcatatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatggctcgacagatct

SEQ ID NO: 141 - protein, 186 aa, Mus musculus
  dihydrofolate reductase
VRPLNCIVAVSQNMGIGKNGDLPWPPLRNEFKYFQRMTTTSSVEGKQNLVIMGRKTWFSIPEKNRPLKDRINIVLSRELKEPPRGAHFLAKSLDDALRLIEQPELASKVDMVWIVGGSSVYQEAMNQPGHLRLFVTRIMQEFESDTFFPEIDLGKYKLLPEYPGVLSEVQEEKGIKYKFEVYEKKD

SEQ ID NO: 142 - protein, 6 aa, Artificial Sequence
  Hexa His Tag
HHHHHH

SEQ ID NO: 143 - protein, 8 aa, Artificial Sequence
  Flag Tag
DYKDDDDK

SEQ ID NO: 144 - protein, 22 aa, Homo sapiens
  Human IgK signal peptide
MDMRVPAQLLGLLLLWLPGARG

SEQ ID NO: 145 - protein, 21 aa, Mus musculus
  Mouse IgK signal peptide
METDTLLLWVLLLWVPGSTGD

SEQ ID NO: 146 - DNA, 1500 bp, Artificial Sequence
  SPAM1-SSVA codon optimized DNA with NheI and BamHI restriction sites
gctagcatggacatgagggtaccagcccagctgttgggccttcttctgctttggctccctggggcaaggggacttaacttcagagctccccctgtaatcccaaacgtccccttcctgtgggcatggaacgcccctagcgaattctgtttggggaaatttgacgaacctctggacatgtctctgttttcttttatcggtagccctcgaatcaacgctaccggacagggggtgacaatcttttacgtggatcgtctgggctattacccttacatcgacagcattactggggtgaccgtgaacggaggcattcctcagaaaatatcactgcaggaccacctggacaaagctaagaaggatattacattctacatgccagtggacaatctcggaatggctgtgattgactgggaggagtggagacctacttgggcccgaaattggaagcccaaggatgtgtataagaaccgatccattgagctggtgcagcagcagaacgtgcagctgtcccttacagaagccaccgaaaaagctaagcaggaattcgagaaagctgggaaggatttcctggttgagacaataaaacttgggaaactgcttagacctaaccacctctggggctattatttgttccccgattgctacaatcaccactataagaagcccggctacaacggatcttgtttcaacgtcgaaattaaaagaaacgatgacctctcttggttgtggaatgagtctactgcactctacccctctatatatctcaacacacagcagtccccagtagccgctaccctctacgttcggaatagagtgagggaagccatcagggtgtccaagatccccgatgccaaatctcccctcccagtgtttgcctacaccaggatcgtgtttaccgaccaggtgttgaagttcctgagccaggacgagctcgtgtatacttttggcgagacagttgctctgggagcctctgggatcgtgatctggggcactctgagtattatgcgatcaatgaagtcctgcctgctgttggataactacatggagacaatcctgaacccatatatcattaacgtgactttggccgctaagatgtgttcacaggtgctgtgtcaagagcagggagtatgcattaggaagaactggaactcaagcgattatctccatctgaacccagataattttgcaatccagctggaaaagggtggtaaattcactgtccgagggaagcccacactcgaggatctcgaacagtttagtgaaaagttctactgtagctgctatagcactctgagttgtaaggaaaaagccgatgtgaaagacactgatgccgttgacgtttgcatcgccgatggggtgtgtattgacgcctttctcaagccaccaatggagactgaggagccccagatcttttacaacgcctccccctccaccttgagtgctaccatgttcatcgtatctatacttttcctgattatatcaagcgtggcatgataaggatcc

SEQ ID NO: 147 - DNA, 1494 bp, Artificial Sequence
  SPAM1-IISS codon optimized DNA with NheI and BamHI restriction sites
gctagcatggacatgagggtaccagcccagctgttgggccttcttctgctttggctccctggggcaaggggacttaacttcagagctccccctgtaatcccaaacgtccccttcctgtgggcatggaacgcccctagcgaattctgtttggggaaatttgacgaacctctggacatgtctctgttttcttttatcggtagccctcgaatcaacgctaccggacagggggtgacaatcttttacgtggatcgtctgggctattacccttacatcgacagcattactggggtgaccgtgaacggaggcattcctcagaaaatatcactgcaggaccacctggacaaagctaagaaggatattacattctacatgccagtggacaatctcggaatggctgtgattgactgggaggagtggagacctacttgggcccgaaattggaagcccaaggatgtgtataagaaccgatccattgagctggtgcagcagcagaacgtgcagctgtcccttacagaagccaccgaaaaagctaagcaggaattcgagaaagctgggaaggatttcctggttgagacaataaaacttgggaaactgcttagacctaaccacctctggggctattatttgttccccgattgctacaatcaccactataagaagcccggctacaacggatcttgtttcaacgtcgaaattaaaagaaacgatgacctctcttggttgtggaatgagtctactgcactctacccctctatatatctcaacacacagcagtccccagtagccgctaccctctacgttcggaatagagtgagggaagccatcagggtgtccaagatccccgatgccaaatctcccctcccagtgtttgcctacaccaggatcgtgtttaccgaccaggtgttgaagttcctgagccaggacgagctcgtgtatacttttggcgagacagttgctctgggagcctctgggatcgtgatctggggcactctgagtattatgcgatcaatgaagtcctgcctgctgttggataactacatggagacaatcctgaacccatatatcattaacgtgactttggccgctaagatgtgttcacaggtgctgtgtcaagagcagggagtatgcattaggaagaactggaactcaagcgattatctccatctgaacccagataattttgcaatccagctggaaaagggtggtaaattcactgtccgagggaagcccacactcgaggatctcgaacagtttagtgaaaagttctactgtagctgctatagcactctgagttgtaaggaaaaagccgatgtgaaagacactgatgccgttgacgtttgcatcgccgatggggtgtgtattgacgcctttctcaagccaccaatggagactgaggagccccagatcttttacaacgcctccccctccaccttgagtgctaccatgttcatcgtatctatacttttcctgattatatcaagctgataaggatcc

SEQ ID NO: 148 - DNA, 1488 bp, Artificial Sequence
  SPAM1-FLII codon optimized DNA with NheI and BamHI restriction sites
gctagcatggacatgagggtaccagcccagctgttgggccttcttctgctttggctccctggggcaaggggacttaacttcagagctccccctgtaatcccaaacgtccccttcctgtgggcatggaacgcccctagcgaattctgtttggggaaatttgacgaacctctggacatgtctctgttttcttttatcggtagccctcgaatcaacgctaccggacagggggtgacaatcttttacgtggatcgtctgggctattacccttacatcgacagcattactggggtgaccgtgaacggaggcattcctcagaaaatatcactgcaggaccacctggacaaagctaagaaggatattacattctacatgccagtggacaatctcggaatggctgtgattgactgggaggagtggagacctacttgggcccgaaattggaagcccaaggatgtgtataagaaccgatccattgagctggtgcagcagcagaacgtgcagctgtcccttacagaagccaccgaaaaagctaagcaggaattcgagaaagctgggaaggatttcctggttgagacaataaaacttgggaaactgcttagacctaaccacctctggggctattatttgttccccgattgctacaatcaccactataagaagcccggctacaacggatcttgtttcaacgtcgaaattaaaagaaacgatgacctctcttggttgtggaatgagtctactgcactctacccctctatatatctcaacacacagcagtccccagtagccgctaccctctacgttcggaatagagtgagggaagccatcagggtgtccaagatccccgatgccaaatctcccctcccagtgtttgcctacaccaggatcgtgtttaccgaccaggtgttgaagttcctgagccaggacgagctcgtgtatacttttggcgagacagttgctctgggagcctctgggatcgtgatctggggcactctgagtattatgcgatcaatgaagtcctgcctgctgttggataactacatggagacaatcctgaacccatatatcattaacgtgactttggccgctaagatgtgttcacaggtgctgtgtcaagagcagggagtatgcattaggaagaactggaactcaagcgattatctccatctgaacccagataattttgcaatccagctggaaaagggtggtaaattcactgtccgagggaagcccacactcgaggatctcgaacagtttagtgaaaagttctactgtagctgctatagcactctgagttgtaaggaaaaagccgatgtgaaagacactgatgccgttgacgtttgcatcgccgatggggtgtgtattgacgcctttctcaagccaccaatggagactgaggagccccagatcttttacaacgcctccccctccaccttgagtgctaccatgttcatcgtatctatacttttcctgattatatgataaggatcc

SEQ ID NO: 149 - DNA, 1482 bp, Artificial Sequence
  SPAM1-ILFL codon optimized DNA with NheI and BamHI restriction sites
gctagcatggacatgagggtaccagcccagctgttgggccttcttctgctttggctccctggggcaaggggacttaacttcagagctccccctgtaatcccaaacgtccccttcctgtgggcatggaacgcccctagcgaattctgtttggggaaatttgacgaacctctggacatgtctctgttttcttttatcggtagccctcgaatcaacgctaccggacagggggtgacaatcttttacgtggatcgtctgggctattacccttacatcgacagcattactggggtgaccgtgaacggaggcattcctcagaaaatatcactgcaggaccacctggacaaagctaagaaggatattacattctacatgccagtggacaatctcggaatggctgtgattgactgggaggagtggagacctacttgggcccgaaattggaagcccaaggatgtgtataagaaccgatccattgagctggtgcagcagcagaacgtgcagctgtcccttacagaagccaccgaaaaagctaagcaggaattcgagaaagctgggaaggatttcctggttgagacaataaaacttgggaaactgcttagacctaaccacctctggggctattatttgttccccgattgctacaatcaccactataagaagcccggctacaacggatcttgtttcaacgtcgaaattaaaagaaacgatgacctctcttggttgtggaatgagtctactgcactctacccctctatatatctcaacacacagcagtccccagtagccgctaccctctacgttcggaatagagtgagggaagccatcagggtgtccaagatccccgatgccaaatctcccctcccagtgtttgcctacaccaggatcgtgtttaccgaccaggtgttgaagttcctgagccaggacgagctcgtgtatacttttggcgagacagttgctctgggagcctctgggatcgtgatctggggcactctgagtattatgcgatcaatgaagtcctgcctgctgttggataactacatggagacaatcctgaacccatatatcattaacgtgactttggccgctaagatgtgttcacaggtgctgtgtcaagagcagggagtatgcattaggaagaactggaactcaagcgattatctccatctgaacccagataattttgcaatccagctggaaaagggtggtaaattcactgtccgagggaagcccacactcgaggatctcgaacagtttagtgaaaagttctactgtagctgctatagcactctgagttgtaaggaaaaagccgatgtgaaagacactgatgccgttgacgtttgcatcgccgatggggtgtgtattgacgcctttctcaagccaccaatggagactgaggagccccagatcttttacaacgcctccccctccaccttgagtgctaccatgttcatcgtatctatacttttcctgtgataaggatcc

SEQ ID NO: 150 - DNA, 1476 bp, Artificial Sequence
  SPAM1-VSIL codon optimized DNA with NheI and BamHI restriction sites
gctagcatggacatgagggtaccagcccagctgttgggccttcttctgctttggctccctggggcaaggggacttaacttcagagctccccctgtaatcccaaacgtccccttcctgtgggcatggaacgcccctagcgaattctgtttggggaaatttgacgaacctctggacatgtctctgttttcttttatcggtagccctcgaatcaacgctaccggacagggggtgacaatcttttacgtggatcgtctgggctattacccttacatcgacagcattactggggtgaccgtgaacggaggcattcctcagaaaatatcactgcaggaccacctggacaaagctaagaaggatattacattctacatgccagtggacaatctcggaatggctgtgattgactgggaggagtggagacctacttgggcccgaaattggaagcccaaggatgtgtataagaaccgatccattgagctggtgcagcagcagaacgtgcagctgtcccttacagaagccaccgaaaaagctaagcaggaattcgagaaagctgggaaggatttcctggttgagacaataaaacttgggaaactgcttagacctaaccacctctggggctattatttgttccccgattgctacaatcaccactataagaagcccggctacaacggatcttgtttcaacgtcgaaattaaaagaaacgatgacctctcttggttgtggaatgagtctactgcactctacccctctatatatctcaacacacagcagtccccagtagccgctaccctctacgttcggaatagagtgagggaagccatcagggtgtccaagatccccgatgccaaatctcccctcccagtgtttgcctacaccaggatcgtgtttaccgaccaggtgttgaagttcctgagccaggacgagctcgtgtatacttttggcgagacagttgctctgggagcctctgggatcgtgatctggggcactctgagtattatgcgatcaatgaagtcctgcctgctgttggataactacatggagacaatcctgaacccatatatcattaacgtgactttggccgctaagatgtgttcacaggtgctgtgtcaagagcagggagtatgcattaggaagaactggaactcaagcgattatctccatctgaacccagataattttgcaatccagctggaaaagggtggtaaattcactgtccgagggaagcccacactcgaggatctcgaacagtttagtgaaaagttctactgtagctgctatagcactctgagttgtaaggaaaaagccgatgtgaaagacactgatgccgttgacgtttgcatcgccgatggggtgtgtattgacgcctttctcaagccaccaatggagactgaggagccccagatcttttacaacgcctccccctccaccttgagtgctaccatgttcatcgtatctatactttgataaggatcc

SEQ ID NO: 151 - DNA, 1470 bp, Artificial Sequence
  SPAM1-FIVS codon optimized DNA with NheI and BamHI restriction sites
gctagcatggacatgagggtaccagcccagctgttgggccttcttctgctttggctccctggggcaaggggacttaacttcagagctccccctgtaatcccaaacgtccccttcctgtgggcatggaacgcccctagcgaattctgtttggggaaatttgacgaacctctggacatgtctctgttttcttttatcggtagccctcgaatcaacgctaccggacagggggtgacaatcttttacgtggatcgtctgggctattacccttacatcgacagcattactggggtgaccgtgaacggaggcattcctcagaaaatatcactgcaggaccacctggacaaagctaagaaggatattacattctacatgccagtggacaatctcggaatggctgtgattgactgggaggagtggagacctacttgggcccgaaattggaagcccaaggatgtgtataagaaccgatccattgagctggtgcagcagcagaacgtgcagctgtcccttacagaagccaccgaaaaagctaagcaggaattcgagaaagctgggaaggatttcctggttgagacaataaaacttgggaaactgcttagacctaaccacctctggggctattatttgttccccgattgctacaatcaccactataagaagcccggctacaacggatcttgtttcaacgtcgaaattaaaagaaacgatgacctctcttggttgtggaatgagtctactgcactctacccctctatatatctcaacacacagcagtccccagtagccgctaccctctacgttcggaatagagtgagggaagccatcagggtgtccaagatccccgatgccaaatctcccctcccagtgtttgcctacaccaggatcgtgtttaccgaccaggtgttgaagttcctgagccaggacgagctcgtgtatacttttggcgagacagttgctctgggagcctctgggatcgtgatctggggcactctgagtattatgcgatcaatgaagtcctgcctgctgttggataactacatggagacaatcctgaacccatatatcattaacgtgactttggccgctaagatgtgttcacaggtgctgtgtcaagagcagggagtatgcattaggaagaactggaactcaagcgattatctccatctgaacccagataattttgcaatccagctggaaaagggtggtaaattcactgtccgagggaagcccacactcgaggatctcgaacagtttagtgaaaagttctactgtagctgctatagcactctgagttgtaaggaaaaagccgatgtgaaagacactgatgccgttgacgtttgcatcgccgatggggtgtgtattgacgcctttctcaagccaccaatggagactgaggagccccagatcttttacaacgcctccccctccaccttgagtgctaccatgttcatcgtatcttgataaggatcc

SEQ ID NO: 152 - DNA, 1464 bp, Artificial Sequence
  SPAM1-TMFI codon optimized DNA with NheI and BamHI restriction sites
gctagcatggacatgagggtaccagcccagctgttgggccttcttctgctttggctccctggggcaaggggacttaacttcagagctccccctgtaatcccaaacgtccccttcctgtgggcatggaacgcccctagcgaattctgtttggggaaatttgacgaacctctggacatgtctctgttttcttttatcggtagccctcgaatcaacgctaccggacagggggtgacaatcttttacgtggatcgtctgggctattacccttacatcgacagcattactggggtgaccgtgaacggaggcattcctcagaaaatatcactgcaggaccacctggacaaagctaagaaggatattacattctacatgccagtggacaatctcggaatggctgtgattgactgggaggagtggagacctacttgggcccgaaattggaagcccaaggatgtgtataagaaccgatccattgagctggtgcagcagcagaacgtgcagctgtcccttacagaagccaccgaaaaagctaagcaggaattcgagaaagctgggaaggatttcctggttgagacaataaaacttgggaaactgcttagacctaaccacctctggggctattatttgttccccgattgctacaatcaccactataagaagcccggctacaacggatcttgtttcaacgtcgaaattaaaagaaacgatgacctctcttggttgtggaatgagtctactgcactctacccctctatatatctcaacacacagcagtccccagtagccgctaccctctacgttcggaatagagtgagggaagccatcagggtgtccaagatccccgatgccaaatctcccctcccagtgtttgcctacaccaggatcgtgtttaccgaccaggtgttgaagttcctgagccaggacgagctcgtgtatacttttggcgagacagttgctctgggagcctctgggatcgtgatctggggcactctgagtattatgcgatcaatgaagtcctgcctgctgttggataactacatggagacaatcctgaacccatatatcattaacgtgactttggccgctaagatgtgttcacaggtgctgtgtcaagagcagggagtatgcattaggaagaactggaactcaagcgattatctccatctgaacccagataattttgcaatccagctggaaaagggtggtaaattcactgtccgagggaagcccacactcgaggatctcgaacagtttagtgaaaagttctactgtagctgctatagcactctgagttgtaaggaaaaagccgatgtgaaagacactgatgccgttgacgtttgcatcgccgatggggtgtgtattgacgcctttctcaagccaccaatggagactgaggagccccagatcttttacaacgcctccccctccaccttgagtgctaccatgttcatctgataaggatcc

SEQ ID NO: 153 - DNA, 1458 bp, Artificial Sequence
  SPAM1-SATM codon optimized DNA with NheI and BamHI restriction sites
gctagcatggacatgagggtaccagcccagctgttgggccttcttctgctttggctccctggggcaaggggacttaacttcagagctccccctgtaatcccaaacgtccccttcctgtgggcatggaacgcccctagcgaattctgtttggggaaatttgacgaacctctggacatgtctctgttttcttttatcggtagccctcgaatcaacgctaccggacagggggtgacaatcttttacgtggatcgtctgggctattacccttacatcgacagcattactggggtgaccgtgaacggaggcattcctcagaaaatatcactgcaggaccacctggacaaagctaagaaggatattacattctacatgccagtggacaatctcggaatggctgtgattgactgggaggagtggagacctacttgggcccgaaattggaagcccaaggatgtgtataagaaccgatccattgagctggtgcagcagcagaacgtgcagctgtcccttacagaagccaccgaaaaagctaagcaggaattcgagaaagctgggaaggatttcctggttgagacaataaaacttgggaaactgcttagacctaaccacctctggggctattatttgttccccgattgctacaatcaccactataagaagcccggctacaacggatcttgtttcaacgtcgaaattaaaagaaacgatgacctctcttggttgtggaatgagtctactgcactctacccctctatatatctcaacacacagcagtccccagtagccgctaccctctacgttcggaatagagtgagggaagccatcagggtgtccaagatccccgatgccaaatctcccctcccagtgtttgcctacaccaggatcgtgtttaccgaccaggtgttgaagttcctgagccaggacgagctcgtgtatacttttggcgagacagttgctctgggagcctctgggatcgtgatctggggcactctgagtattatgcgatcaatgaagtcctgcctgctgttggataactacatggagacaatcctgaacccatatatcattaacgtgactttggccgctaagatgtgttcacaggtgctgtgtcaagagcagggagtatgcattaggaagaactggaactcaagcgattatctccatctgaacccagataattttgcaatccagctggaaaagggtggtaaattcactgtccgagggaagcccacactcgaggatctcgaacagtttagtgaaaagttctactgtagctgctatagcactctgagttgtaaggaaaaagccgatgtgaaagacactgatgccgttgacgtttgcatcgccgatggggtgtgtattgacgcctttctcaagccaccaatggagactgaggagccccagatcttttacaacgcctccccctccaccttgagtgctaccatgtgataaggatcc

SEQ ID NO: 154 - DNA, 1452 bp, Artificial Sequence
  SPAM1-TLSA codon optimized DNA with NheI and BamHI restriction sites
gctagcatggacatgagggtaccagcccagctgttgggccttcttctgctttggctccctggggcaaggggacttaacttcagagctccccctgtaatcccaaacgtccccttcctgtgggcatggaacgcccctagcgaattctgtttggggaaatttgacgaacctctggacatgtctctgttttcttttatcggtagccctcgaatcaacgctaccggacagggggtgacaatcttttacgtggatcgtctgggctattacccttacatcgacagcattactggggtgaccgtgaacggaggcattcctcagaaaatatcactgcaggaccacctggacaaagctaagaaggatattacattctacatgccagtggacaatctcggaatggctgtgattgactgggaggagtggagacctacttgggcccgaaattggaagcccaaggatgtgtataagaaccgatccattgagctggtgcagcagcagaacgtgcagctgtcccttacagaagccaccgaaaaagctaagcaggaattcgagaaagctgggaaggatttcctggttgagacaataaaacttgggaaactgcttagacctaaccacctctggggctattatttgttccccgattgctacaatcaccactataagaagcccggctacaacggatcttgtttcaacgtcgaaattaaaagaaacgatgacctctcttggttgtggaatgagtctactgcactctacccctctatatatctcaacacacagcagtccccagtagccgctaccctctacgttcggaatagagtgagggaagccatcagggtgtccaagatccccgatgccaaatctcccctcccagtgtttgcctacaccaggatcgtgtttaccgaccaggtgttgaagttcctgagccaggacgagctcgtgtatacttttggcgagacagttgctctgggagcctctgggatcgtgatctggggcactctgagtattatgcgatcaatgaagtcctgcctgctgttggataactacatggagacaatcctgaacccatatatcattaacgtgactttggccgctaagatgtgttcacaggtgctgtgtcaagagcagggagtatgcattaggaagaactggaactcaagcgattatctccatctgaacccagataattttgcaatccagctggaaaagggtggtaaattcactgtccgagggaagcccacactcgaggatctcgaacagtttagtgaaaagttctactgtagctgctatagcactctgagttgtaaggaaaaagccgatgtgaaagacactgatgccgttgacgtttgcatcgccgatggggtgtgtattgacgcctttctcaagccaccaatggagactgaggagccccagatcttttacaacgcctccccctccaccttgagtgcttgataaggatcc

SEQ ID NO: 155 - DNA, 1446 bp, Artificial Sequence
  SPAM1-PSTL codon optimized DNA with NheI and BamHI restriction sites
gctagcatggacatgagggtaccagcccagctgttgggccttcttctgctttggctccctggggcaaggggacttaacttcagagctccccctgtaatcccaaacgtccccttcctgtgggcatggaacgcccctagcgaattctgtttggggaaatttgacgaacctctggacatgtctctgttttcttttatcggtagccctcgaatcaacgctaccggacagggggtgacaatcttttacgtggatcgtctgggctattacccttacatcgacagcattactggggtgaccgtgaacggaggcattcctcagaaaatatcactgcaggaccacctggacaaagctaagaaggatattacattctacatgccagtggacaatctcggaatggctgtgattgactgggaggagtggagacctacttgggcccgaaattggaagcccaaggatgtgtataagaaccgatccattgagctggtgcagcagcagaacgtgcagctgtcccttacagaagccaccgaaaaagctaagcaggaattcgagaaagctgggaaggatttcctggttgagacaataaaacttgggaaactgcttagacctaaccacctctggggctattatttgttccccgattgctacaatcaccactataagaagcccggctacaacggatcttgtttcaacgtcgaaattaaaagaaacgatgacctctcttggttgtggaatgagtctactgcactctacccctctatatatctcaacacacagcagtccccagtagccgctaccctctacgttcggaatagagtgagggaagccatcagggtgtccaagatccccgatgccaaatctcccctcccagtgtttgcctacaccaggatcgtgtttaccgaccaggtgttgaagttcctgagccaggacgagctcgtgtatacttttggcgagacagttgctctgggagcctctgggatcgtgatctggggcactctgagtattatgcgatcaatgaagtcctgcctgctgttggataactacatggagacaatcctgaacccatatatcattaacgtgactttggccgctaagatgtgttcacaggtgctgtgtcaagagcagggagtatgcattaggaagaactggaactcaagcgattatctccatctgaacccagataattttgcaatccagctggaaaagggtggtaaattcactgtccgagggaagcccacactcgaggatctcgaacagtttagtgaaaagttctactgtagctgctatagcactctgagttgtaaggaaaaagccgatgtgaaagacactgatgccgttgacgtttgcatcgccgatggggtgtgtattgacgcctttctcaagccaccaatggagactgaggagccccagatcttttacaacgcctccccctccaccttgtgataaggatcc

SEQ ID NO: 156 - DNA, 1440 bp, Artificial Sequence
  SPAM1-ASPS codon optimized DNA with NheI and BamHI restriction sites
gctagcatggacatgagggtaccagcccagctgttgggccttcttctgctttggctccctggggcaaggggacttaacttcagagctccccctgtaatcccaaacgtccccttcctgtgggcatggaacgcccctagcgaattctgtttggggaaatttgacgaacctctggacatgtctctgttttcttttatcggtagccctcgaatcaacgctaccggacagggggtgacaatcttttacgtggatcgtctgggctattacccttacatcgacagcattactggggtgaccgtgaacggaggcattcctcagaaaatatcactgcaggaccacctggacaaagctaagaaggatattacattctacatgccagtggacaatctcggaatggctgtgattgactgggaggagtggagacctacttgggcccgaaattggaagcccaaggatgtgtataagaaccgatccattgagctggtgcagcagcagaacgtgcagctgtcccttacagaagccaccgaaaaagctaagcaggaattcgagaaagctgggaaggatttcctggttgagacaataaaacttgggaaactgcttagacctaaccacctctggggctattatttgttccccgattgctacaatcaccactataagaagcccggctacaacggatcttgtttcaacgtcgaaattaaaagaaacgatgacctctcttggttgtggaatgagtctactgcactctacccctctatatatctcaacacacagcagtccccagtagccgctaccctctacgttcggaatagagtgagggaagccatcagggtgtccaagatccccgatgccaaatctcccctcccagtgtttgcctacaccaggatcgtgtttaccgaccaggtgttgaagttcctgagccaggacgagctcgtgtatacttttggcgagacagttgctctgggagcctctgggatcgtgatctggggcactctgagtattatgcgatcaatgaagtcctgcctgctgttggataactacatggagacaatcctgaacccatatatcattaacgtgactttggccgctaagatgtgttcacaggtgctgtgtcaagagcagggagtatgcattaggaagaactggaactcaagcgattatctccatctgaacccagataattttgcaatccagctggaaaagggtggtaaattcactgtccgagggaagcccacactcgaggatctcgaacagtttagtgaaaagttctactgtagctgctatagcactctgagttgtaaggaaaaagccgatgtgaaagacactgatgccgttgacgtttgcatcgccgatggggtgtgtattgacgcctttctcaagccaccaatggagactgaggagccccagatcttttacaacgcctccccctcctgataaggatcc

SEQ ID NO: 157 - DNA, 1434 bp, Artificial Sequence
  SPAM1-YNAS codon optimized DNA with NheI and BamHI restriction sites
gctagcatggacatgagggtaccagcccagctgttgggccttcttctgctttggctccctggggcaaggggacttaacttcagagctccccctgtaatcccaaacgtccccttcctgtgggcatggaacgcccctagcgaattctgtttggggaaatttgacgaacctctggacatgtctctgttttcttttatcggtagccctcgaatcaacgctaccggacagggggtgacaatcttttacgtggatcgtctgggctattacccttacatcgacagcattactggggtgaccgtgaacggaggcattcctcagaaaatatcactgcaggaccacctggacaaagctaagaaggatattacattctacatgccagtggacaatctcggaatggctgtgattgactgggaggagtggagacctacttgggcccgaaattggaagcccaaggatgtgtataagaaccgatccattgagctggtgcagcagcagaacgtgcagctgtcccttacagaagccaccgaaaaagctaagcaggaattcgagaaagctgggaaggatttcctggttgagacaataaaacttgggaaactgcttagacctaaccacctctggggctattatttgttccccgattgctacaatcaccactataagaagcccggctacaacggatcttgtttcaacgtcgaaattaaaagaaacgatgacctctcttggttgtggaatgagtctactgcactctacccctctatatatctcaacacacagcagtccccagtagccgctaccctctacgttcggaatagagtgagggaagccatcagggtgtccaagatccccgatgccaaatctcccctcccagtgtttgcctacaccaggatcgtgtttaccgaccaggtgttgaagttcctgagccaggacgagctcgtgtatacttttggcgagacagttgctctgggagcctctgggatcgtgatctggggcactctgagtattatgcgatcaatgaagtcctgcctgctgttggataactacatggagacaatcctgaacccatatatcattaacgtgactttggccgctaagatgtgttcacaggtgctgtgtcaagagcagggagtatgcattaggaagaactggaactcaagcgattatctccatctgaacccagataattttgcaatccagctggaaaagggtggtaaattcactgtccgagggaagcccacactcgaggatctcgaacagtttagtgaaaagttctactgtagctgctatagcactctgagttgtaaggaaaaagccgatgtgaaagacactgatgccgttgacgtttgcatcgccgatggggtgtgtattgacgcctttctcaagccaccaatggagactgaggagccccagatcttttacaacgcctcctgataaggatcc

SEQ ID NO: 158 - DNA, 1431 bp, Artificial Sequence
  SPAM1-FYNA codon optimized DNA with NheI and BamHI restriction sites
gctagcatggacatgagggtaccagcccagctgttgggccttcttctgctttggctccctggggcaaggggacttaacttcagagctccccctgtaatcccaaacgtccccttcctgtgggcatggaacgcccctagcgaattctgtttggggaaatttgacgaacctctggacatgtctctgttttcttttatcggtagccctcgaatcaacgctaccggacagggggtgacaatcttttacgtggatcgtctgggctattacccttacatcgacagcattactggggtgaccgtgaacggaggcattcctcagaaaatatcactgcaggaccacctggacaaagctaagaaggatattacattctacatgccagtggacaatctcggaatggctgtgattgactgggaggagtggagacctacttgggcccgaaattggaagcccaaggatgtgtataagaaccgatccattgagctggtgcagcagcagaacgtgcagctgtcccttacagaagccaccgaaaaagctaagcaggaattcgagaaagctgggaaggatttcctggttgagacaataaaacttgggaaactgcttagacctaaccacctctggggctattatttgttccccgattgctacaatcaccactataagaagcccggctacaacggatcttgtttcaacgtcgaaattaaaagaaacgatgacctctcttggttgtggaatgagtctactgcactctacccctctatatatctcaacacacagcagtccccagtagccgctaccctctacgttcggaatagagtgagggaagccatcagggtgtccaagatccccgatgccaaatctcccctcccagtgtttgcctacaccaggatcgtgtttaccgaccaggtgttgaagttcctgagccaggacgagctcgtgtatacttttggcgagacagttgctctgggagcctctgggatcgtgatctggggcactctgagtattatgcgatcaatgaagtcctgcctgctgttggataactacatggagacaatcctgaacccatatatcattaacgtgactttggccgctaagatgtgttcacaggtgctgtgtcaagagcagggagtatgcattaggaagaactggaactcaagcgattatctccatctgaacccagataattttgcaatccagctggaaaagggtggtaaattcactgtccgagggaagcccacactcgaggatctcgaacagtttagtgaaaagttctactgtagctgctatagcactctgagttgtaaggaaaaagccgatgtgaaagacactgatgccgttgacgtttgcatcgccgatggggtgtgtattgacgcctttctcaagccaccaatggagactgaggagccccagatcttttacaacgcctgataaggatcc

SEQ ID NO: 159 - DNA, 1428 bp, Artificial Sequence
  SPAM1-IFYN codon optimized DNA with NheI and BamHI restriction sites
gctagcatggacatgagggtaccagcccagctgttgggccttcttctgctttggctccctggggcaaggggacttaacttcagagctccccctgtaatcccaaacgtccccttcctgtgggcatggaacgcccctagcgaattctgtttggggaaatttgacgaacctctggacatgtctctgttttcttttatcggtagccctcgaatcaacgctaccggacagggggtgacaatcttttacgtggatcgtctgggctattacccttacatcgacagcattactggggtgaccgtgaacggaggcattcctcagaaaatatcactgcaggaccacctggacaaagctaagaaggatattacattctacatgccagtggacaatctcggaatggctgtgattgactgggaggagtggagacctacttgggcccgaaattggaagcccaaggatgtgtataagaaccgatccattgagctggtgcagcagcagaacgtgcagctgtcccttacagaagccaccgaaaaagctaagcaggaattcgagaaagctgggaaggatttcctggttgagacaataaaacttgggaaactgcttagacctaaccacctctggggctattatttgttccccgattgctacaatcaccactataagaagcccggctacaacggatcttgtttcaacgtcgaaattaaaagaaacgatgacctctcttggttgtggaatgagtctactgcactctacccctctatatatctcaacacacagcagtccccagtagccgctaccctctacgttcggaatagagtgagggaagccatcagggtgtccaagatccccgatgccaaatctcccctcccagtgtttgcctacaccaggatcgtgtttaccgaccaggtgttgaagttcctgagccaggacgagctcgtgtatacttttggcgagacagttgctctgggagcctctgggatcgtgatctggggcactctgagtattatgcgatcaatgaagtcctgcctgctgttggataactacatggagacaatcctgaacccatatatcattaacgtgactttggccgctaagatgtgttcacaggtgctgtgtcaagagcagggagtatgcattaggaagaactggaactcaagcgattatctccatctgaacccagataattttgcaatccagctggaaaagggtggtaaattcactgtccgagggaagcccacactcgaggatctcgaacagtttagtgaaaagttctactgtagctgctatagcactctgagttgtaaggaaaaagccgatgtgaaagacactgatgccgttgacgtttgcatcgccgatggggtgtgtattgacgcctttctcaagccaccaatggagactgaggagccccagatcttttacaactgataaggatcc

SEQ ID NO: 160 - DNA, 1425 bp, Artificial Sequence
  SPAM1-QIFY codon optimized DNA with NheI and BamHI restriction sites
gctagcatggacatgagggtaccagcccagctgttgggccttcttctgctttggctccctggggcaaggggacttaacttcagagctccccctgtaatcccaaacgtccccttcctgtgggcatggaacgcccctagcgaattctgtttggggaaatttgacgaacctctggacatgtctctgttttcttttatcggtagccctcgaatcaacgctaccggacagggggtgacaatcttttacgtggatcgtctgggctattacccttacatcgacagcattactggggtgaccgtgaacggaggcattcctcagaaaatatcactgcaggaccacctggacaaagctaagaaggatattacattctacatgccagtggacaatctcggaatggctgtgattgactgggaggagtggagacctacttgggcccgaaattggaagcccaaggatgtgtataagaaccgatccattgagctggtgcagcagcagaacgtgcagctgtcccttacagaagccaccgaaaaagctaagcaggaattcgagaaagctgggaaggatttcctggttgagacaataaaacttgggaaactgcttagacctaaccacctctggggctattatttgttccccgattgctacaatcaccactataagaagcccggctacaacggatcttgtttcaacgtcgaaattaaaagaaacgatgacctctcttggttgtggaatgagtctactgcactctacccctctatatatctcaacacacagcagtccccagtagccgctaccctctacgttcggaatagagtgagggaagccatcagggtgtccaagatccccgatgccaaatctcccctcccagtgtttgcctacaccaggatcgtgtttaccgaccaggtgttgaagttcctgagccaggacgagctcgtgtatacttttggcgagacagttgctctgggagcctctgggatcgtgatctggggcactctgagtattatgcgatcaatgaagtcctgcctgctgttggataactacatggagacaatcctgaacccatatatcattaacgtgactttggccgctaagatgtgttcacaggtgctgtgtcaagagcagggagtatgcattaggaagaactggaactcaagcgattatctccatctgaacccagataattttgcaatccagctggaaaagggtggtaaattcactgtccgagggaagcccacactcgaggatctcgaacagtttagtgaaaagttctactgtagctgctatagcactctgagttgtaaggaaaaagccgatgtgaaagacactgatgccgttgacgtttgcatcgccgatggggtgtgtattgacgcctttctcaagccaccaatggagactgaggagccccagatcttttactgataaggatcc

SEQ ID NO: 161 - DNA, 1422 bp, Artificial Sequence
  SPAM1-PQIF codon optimized DNA with NheI and BamHI restriction sites
gctagcatggacatgagggtaccagcccagctgttgggccttcttctgctttggctccctggggcaaggggacttaacttcagagctccccctgtaatcccaaacgtccccttcctgtgggcatggaacgcccctagcgaattctgtttggggaaatttgacgaacctctggacatgtctctgttttcttttatcggtagccctcgaatcaacgctaccggacagggggtgacaatcttttacgtggatcgtctgggctattacccttacatcgacagcattactggggtgaccgtgaacggaggcattcctcagaaaatatcactgcaggaccacctggacaaagctaagaaggatattacattctacatgccagtggacaatctcggaatggctgtgattgactgggaggagtggagacctacttgggcccgaaattggaagcccaaggatgtgtataagaaccgatccattgagctggtgcagcagcagaacgtgcagctgtcccttacagaagccaccgaaaaagctaagcaggaattcgagaaagctgggaaggatttcctggttgagacaataaaacttgggaaactgcttagacctaaccacctctggggctattatttgttccccgattgctacaatcaccactataagaagcccggctacaacggatcttgtttcaacgtcgaaattaaaagaaacgatgacctctcttggttgtggaatgagtctactgcactctacccctctatatatctcaacacacagcagtccccagtagccgctaccctctacgttcggaatagagtgagggaagccatcagggtgtccaagatccccgatgccaaatctcccctcccagtgtttgcctacaccaggatcgtgtttaccgaccaggtgttgaagttcctgagccaggacgagctcgtgtatacttttggcgagacagttgctctgggagcctctgggatcgtgatctggggcactctgagtattatgcgatcaatgaagtcctgcctgctgttggataactacatggagacaatcctgaacccatatatcattaacgtgactttggccgctaagatgtgttcacaggtgctgtgtcaagagcagggagtatgcattaggaagaactggaactcaagcgattatctccatctgaacccagataattttgcaatccagctggaaaagggtggtaaattcactgtccgagggaagcccacactcgaggatctcgaacagtttagtgaaaagttctactgtagctgctatagcactctgagttgtaaggaaaaagccgatgtgaaagacactgatgccgttgacgtttgcatcgccgatggggtgtgtattgacgcctttctcaagccaccaatggagactgaggagccccagatcttttgataaggatcc

SEQ ID NO: 162 - DNA, 1419 bp, Artificial Sequence
  SPAM1-EPQI codon optimized DNA with NheI and BamHI restriction sites
gctagcatggacatgagggtaccagcccagctgttgggccttcttctgctttggctccctggggcaaggggacttaacttcagagctccccctgtaatcccaaacgtccccttcctgtgggcatggaacgcccctagcgaattctgtttggggaaatttgacgaacctctggacatgtctctgttttcttttatcggtagccctcgaatcaacgctaccggacagggggtgacaatcttttacgtggatcgtctgggctattacccttacatcgacagcattactggggtgaccgtgaacggaggcattcctcagaaaatatcactgcaggaccacctggacaaagctaagaaggatattacattctacatgccagtggacaatctcggaatggctgtgattgactgggaggagtggagacctacttgggcccgaaattggaagcccaaggatgtgtataagaaccgatccattgagctggtgcagcagcagaacgtgcagctgtcccttacagaagccaccgaaaaagctaagcaggaattcgagaaagctgggaaggatttcctggttgagacaataaaacttgggaaactgcttagacctaaccacctctggggctattatttgttccccgattgctacaatcaccactataagaagcccggctacaacggatcttgtttcaacgtcgaaattaaaagaaacgatgacctctcttggttgtggaatgagtctactgcactctacccctctatatatctcaacacacagcagtccccagtagccgctaccctctacgttcggaatagagtgagggaagccatcagggtgtccaagatccccgatgccaaatctcccctcccagtgtttgcctacaccaggatcgtgtttaccgaccaggtgttgaagttcctgagccaggacgagctcgtgtatacttttggcgagacagttgctctgggagcctctgggatcgtgatctggggcactctgagtattatgcgatcaatgaagtcctgcctgctgttggataactacatggagacaatcctgaacccatatatcattaacgtgactttggccgctaagatgtgttcacaggtgctgtgtcaagagcagggagtatgcattaggaagaactggaactcaagcgattatctccatctgaacccagataattttgcaatccagctggaaaagggtggtaaattcactgtccgagggaagcccacactcgaggatctcgaacagtttagtgaaaagttctactgtagctgctatagcactctgagttgtaaggaaaaagccgatgtgaaagacactgatgccgttgacgtttgcatcgccgatggggtgtgtattgacgcctttctcaagccaccaatggagactgaggagccccagatctgataaggatcc

SEQ ID NO: 163 - DNA, 1416 bp, Artificial Sequence
  SPAM1-EEPQ codon optimized DNA with NheI and BamHI restriction sites
gctagcatggacatgagggtaccagcccagctgttgggccttcttctgctttggctccctggggcaaggggacttaacttcagagctccccctgtaatcccaaacgtccccttcctgtgggcatggaacgcccctagcgaattctgtttggggaaatttgacgaacctctggacatgtctctgttttcttttatcggtagccctcgaatcaacgctaccggacagggggtgacaatcttttacgtggatcgtctgggctattacccttacatcgacagcattactggggtgaccgtgaacggaggcattcctcagaaaatatcactgcaggaccacctggacaaagctaagaaggatattacattctacatgccagtggacaatctcggaatggctgtgattgactgggaggagtggagacctacttgggcccgaaattggaagcccaaggatgtgtataagaaccgatccattgagctggtgcagcagcagaacgtgcagctgtcccttacagaagccaccgaaaaagctaagcaggaattcgagaaagctgggaaggatttcctggttgagacaataaaacttgggaaactgcttagacctaaccacctctggggctattatttgttccccgattgctacaatcaccactataagaagcccggctacaacggatcttgtttcaacgtcgaaattaaaagaaacgatgacctctcttggttgtggaatgagtctactgcactctacccctctatatatctcaacacacagcagtccccagtagccgctaccctctacgttcggaatagagtgagggaagccatcagggtgtccaagatccccgatgccaaatctcccctcccagtgtttgcctacaccaggatcgtgtttaccgaccaggtgttgaagttcctgagccaggacgagctcgtgtatacttttggcgagacagttgctctgggagcctctgggatcgtgatctggggcactctgagtattatgcgatcaatgaagtcctgcctgctgttggataactacatggagacaatcctgaacccatatatcattaacgtgactttggccgctaagatgtgttcacaggtgctgtgtcaagagcagggagtatgcattaggaagaactggaactcaagcgattatctccatctgaacccagataattttgcaatccagctggaaaagggtggtaaattcactgtccgagggaagcccacactcgaggatctcgaacagtttagtgaaaagttctactgtagctgctatagcactctgagttgtaaggaaaaagccgatgtgaaagacactgatgccgttgacgtttgcatcgccgatggggtgtgtattgacgcctttctcaagccaccaatggagactgaggagccccagtgataaggatcc

SEQ ID NO: 164 - DNA, 1413 bp, Artificial Sequence
  SPAM1-TEEP codon optimized DNA with NheI and BamHI restriction sites
gctagcatggacatgagggtaccagcccagctgttgggccttcttctgctttggctccctggggcaaggggacttaacttcagagctccccctgtaatcccaaacgtccccttcctgtgggcatggaacgcccctagcgaattctgtttggggaaatttgacgaacctctggacatgtctctgttttcttttatcggtagccctcgaatcaacgctaccggacagggggtgacaatcttttacgtggatcgtctgggctattacccttacatcgacagcattactggggtgaccgtgaacggaggcattcctcagaaaatatcactgcaggaccacctggacaaagctaagaaggatattacattctacatgccagtggacaatctcggaatggctgtgattgactgggaggagtggagacctacttgggcccgaaattggaagcccaaggatgtgtataagaaccgatccattgagctggtgcagcagcagaacgtgcagctgtcccttacagaagccaccgaaaaagctaagcaggaattcgagaaagctgggaaggatttcctggttgagacaataaaacttgggaaactgcttagacctaaccacctctggggctattatttgttccccgattgctacaatcaccactataagaagcccggctacaacggatcttgtttcaacgtcgaaattaaaagaaacgatgacctctcttggttgtggaatgagtctactgcactctacccctctatatatctcaacacacagcagtccccagtagccgctaccctctacgttcggaatagagtgagggaagccatcagggtgtccaagatccccgatgccaaatctcccctcccagtgtttgcctacaccaggatcgtgtttaccgaccaggtgttgaagttcctgagccaggacgagctcgtgtatacttttggcgagacagttgctctgggagcctctgggatcgtgatctggggcactctgagtattatgcgatcaatgaagtcctgcctgctgttggataactacatggagacaatcctgaacccatatatcattaacgtgactttggccgctaagatgtgttcacaggtgctgtgtcaagagcagggagtatgcattaggaagaactggaactcaagcgattatctccatctgaacccagataattttgcaatccagctggaaaagggtggtaaattcactgtccgagggaagcccacactcgaggatctcgaacagtttagtgaaaagttctactgtagctgctatagcactctgagttgtaaggaaaaagccgatgtgaaagacactgatgccgttgacgtttgcatcgccgatggggtgtgtattgacgcctttctcaagccaccaatggagactgaggagccctgataaggatcc

SEQ ID NO: 165 - DNA, 1410 bp, Artificial Sequence
  SPAM1-ETEE codon optimized DNA with NheI and BamHI restriction sites
gctagcatggacatgagggtaccagcccagctgttgggccttcttctgctttggctccctggggcaaggggacttaacttcagagctccccctgtaatcccaaacgtccccttcctgtgggcatggaacgcccctagcgaattctgtttggggaaatttgacgaacctctggacatgtctctgttttcttttatcggtagccctcgaatcaacgctaccggacagggggtgacaatcttttacgtggatcgtctgggctattacccttacatcgacagcattactggggtgaccgtgaacggaggcattcctcagaaaatatcactgcaggaccacctggacaaagctaagaaggatattacattctacatgccagtggacaatctcggaatggctgtgattgactgggaggagtggagacctacttgggcccgaaattggaagcccaaggatgtgtataagaaccgatccattgagctggtgcagcagcagaacgtgcagctgtcccttacagaagccaccgaaaaagctaagcaggaattcgagaaagctgggaaggatttcctggttgagacaataaaacttgggaaactgcttagacctaaccacctctggggctattatttgttccccgattgctacaatcaccactataagaagcccggctacaacggatcttgtttcaacgtcgaaattaaaagaaacgatgacctctcttggttgtggaatgagtctactgcactctacccctctatatatctcaacacacagcagtccccagtagccgctaccctctacgttcggaatagagtgagggaagccatcagggtgtccaagatccccgatgccaaatctcccctcccagtgtttgcctacaccaggatcgtgtttaccgaccaggtgttgaagttcctgagccaggacgagctcgtgtatacttttggcgagacagttgctctgggagcctctgggatcgtgatctggggcactctgagtattatgcgatcaatgaagtcctgcctgctgttggataactacatggagacaatcctgaacccatatatcattaacgtgactttggccgctaagatgtgttcacaggtgctgtgtcaagagcagggagtatgcattaggaagaactggaactcaagcgattatctccatctgaacccagataattttgcaatccagctggaaaagggtggtaaattcactgtccgagggaagcccacactcgaggatctcgaacagtttagtgaaaagttctactgtagctgctatagcactctgagttgtaaggaaaaagccgatgtgaaagacactgatgccgttgacgtttgcatcgccgatggggtgtgtattgacgcctttctcaagccaccaatggagactgaggagtgataaggatcc

SEQ ID NO: 166 - DNA, 1407 bp, Artificial Sequence
  SPAM1-METE codon optimized DNA with NheI and BamHI restriction sites
gctagcatggacatgagggtaccagcccagctgttgggccttcttctgctttggctccctggggcaaggggacttaacttcagagctccccctgtaatcccaaacgtccccttcctgtgggcatggaacgcccctagcgaattctgtttggggaaatttgacgaacctctggacatgtctctgttttcttttatcggtagccctcgaatcaacgctaccggacagggggtgacaatcttttacgtggatcgtctgggctattacccttacatcgacagcattactggggtgaccgtgaacggaggcattcctcagaaaatatcactgcaggaccacctggacaaagctaagaaggatattacattctacatgccagtggacaatctcggaatggctgtgattgactgggaggagtggagacctacttgggcccgaaattggaagcccaaggatgtgtataagaaccgatccattgagctggtgcagcagcagaacgtgcagctgtcccttacagaagccaccgaaaaagctaagcaggaattcgagaaagctgggaaggatttcctggttgagacaataaaacttgggaaactgcttagacctaaccacctctggggctattatttgttccccgattgctacaatcaccactataagaagcccggctacaacggatcttgtttcaacgtcgaaattaaaagaaacgatgacctctcttggttgtggaatgagtctactgcactctacccctctatatatctcaacacacagcagtccccagtagccgctaccctctacgttcggaatagagtgagggaagccatcagggtgtccaagatccccgatgccaaatctcccctcccagtgtttgcctacaccaggatcgtgtttaccgaccaggtgttgaagttcctgagccaggacgagctcgtgtatacttttggcgagacagttgctctgggagcctctgggatcgtgatctggggcactctgagtattatgcgatcaatgaagtcctgcctgctgttggataactacatggagacaatcctgaacccatatatcattaacgtgactttggccgctaagatgtgttcacaggtgctgtgtcaagagcagggagtatgcattaggaagaactggaactcaagcgattatctccatctgaacccagataattttgcaatccagctggaaaagggtggtaaattcactgtccgagggaagcccacactcgaggatctcgaacagtttagtgaaaagttctactgtagctgctatagcactctgagttgtaaggaaaaagccgatgtgaaagacactgatgccgttgacgtttgcatcgccgatggggtgtgtattgacgcctttctcaagccaccaatggagactgagtgataaggatcc

SEQ ID NO: 167 - DNA, 1404 bp, Artificial Sequence
  SPAM1-PMET codon optimized DNA with NheI and BamHI restriction sites
gctagcatggacatgagggtaccagcccagctgttgggccttcttctgctttggctccctggggcaaggggacttaacttcagagctccccctgtaatcccaaacgtccccttcctgtgggcatggaacgcccctagcgaattctgtttggggaaatttgacgaacctctggacatgtctctgttttcttttatcggtagccctcgaatcaacgctaccggacagggggtgacaatcttttacgtggatcgtctgggctattacccttacatcgacagcattactggggtgaccgtgaacggaggcattcctcagaaaatatcactgcaggaccacctggacaaagctaagaaggatattacattctacatgccagtggacaatctcggaatggctgtgattgactgggaggagtggagacctacttgggcccgaaattggaagcccaaggatgtgtataagaaccgatccattgagctggtgcagcagcagaacgtgcagctgtcccttacagaagccaccgaaaaagctaagcaggaattcgagaaagctgggaaggatttcctggttgagacaataaaacttgggaaactgcttagacctaaccacctctggggctattatttgttccccgattgctacaatcaccactataagaagcccggctacaacggatcttgtttcaacgtcgaaattaaaagaaacgatgacctctcttggttgtggaatgagtctactgcactctacccctctatatatctcaacacacagcagtccccagtagccgctaccctctacgttcggaatagagtgagggaagccatcagggtgtccaagatccccgatgccaaatctcccctcccagtgtttgcctacaccaggatcgtgtttaccgaccaggtgttgaagttcctgagccaggacgagctcgtgtatacttttggcgagacagttgctctgggagcctctgggatcgtgatctggggcactctgagtattatgcgatcaatgaagtcctgcctgctgttggataactacatggagacaatcctgaacccatatatcattaacgtgactttggccgctaagatgtgttcacaggtgctgtgtcaagagcagggagtatgcattaggaagaactggaactcaagcgattatctccatctgaacccagataattttgcaatccagctggaaaagggtggtaaattcactgtccgagggaagcccacactcgaggatctcgaacagtttagtgaaaagttctactgtagctgctatagcactctgagttgtaaggaaaaagccgatgtgaaagacactgatgccgttgacgtttgcatcgccgatggggtgtgtattgacgcctttctcaagccaccaatggagacttgataaggatcc

SEQ ID NO: 168 - DNA, 1401 bp, Artificial Sequence
  SPAM1-PPME codon optimized DNA with NheI and BamHI restriction sites
gctagcatggacatgagggtaccagcccagctgttgggccttcttctgctttggctccctggggcaaggggacttaacttcagagctccccctgtaatcccaaacgtccccttcctgtgggcatggaacgcccctagcgaattctgtttggggaaatttgacgaacctctggacatgtctctgttttcttttatcggtagccctcgaatcaacgctaccggacagggggtgacaatcttttacgtggatcgtctgggctattacccttacatcgacagcattactggggtgaccgtgaacggaggcattcctcagaaaatatcactgcaggaccacctggacaaagctaagaaggatattacattctacatgccagtggacaatctcggaatggctgtgattgactgggaggagtggagacctacttgggcccgaaattggaagcccaaggatgtgtataagaaccgatccattgagctggtgcagcagcagaacgtgcagctgtcccttacagaagccaccgaaaaagctaagcaggaattcgagaaagctgggaaggatttcctggttgagacaataaaacttgggaaactgcttagacctaaccacctctggggctattatttgttccccgattgctacaatcaccactataagaagcccggctacaacggatcttgtttcaacgtcgaaattaaaagaaacgatgacctctcttggttgtggaatgagtctactgcactctacccctctatatatctcaacacacagcagtccccagtagccgctaccctctacgttcggaatagagtgagggaagccatcagggtgtccaagatccccgatgccaaatctcccctcccagtgtttgcctacaccaggatcgtgtttaccgaccaggtgttgaagttcctgagccaggacgagctcgtgtatacttttggcgagacagttgctctgggagcctctgggatcgtgatctggggcactctgagtattatgcgatcaatgaagtcctgcctgctgttggataactacatggagacaatcctgaacccatatatcattaacgtgactttggccgctaagatgtgttcacaggtgctgtgtcaagagcagggagtatgcattaggaagaactggaactcaagcgattatctccatctgaacccagataattttgcaatccagctggaaaagggtggtaaattcactgtccgagggaagcccacactcgaggatctcgaacagtttagtgaaaagttctactgtagctgctatagcactctgagttgtaaggaaaaagccgatgtgaaagacactgatgccgttgacgtttgcatcgccgatggggtgtgtattgacgcctttctcaagccaccaatggagtgataaggatcc

SEQ ID NO: 169 - DNA, 1398 bp, Artificial Sequence
  SPAM1-KPPM codon optimized DNA with NheI and BamHI restriction sites
gctagcatggacatgagggtaccagcccagctgttgggccttcttctgctttggctccctggggcaaggggacttaacttcagagctccccctgtaatcccaaacgtccccttcctgtgggcatggaacgcccctagcgaattctgtttggggaaatttgacgaacctctggacatgtctctgttttcttttatcggtagccctcgaatcaacgctaccggacagggggtgacaatcttttacgtggatcgtctgggctattacccttacatcgacagcattactggggtgaccgtgaacggaggcattcctcagaaaatatcactgcaggaccacctggacaaagctaagaaggatattacattctacatgccagtggacaatctcggaatggctgtgattgactgggaggagtggagacctacttgggcccgaaattggaagcccaaggatgtgtataagaaccgatccattgagctggtgcagcagcagaacgtgcagctgtcccttacagaagccaccgaaaaagctaagcaggaattcgagaaagctgggaaggatttcctggttgagacaataaaacttgggaaactgcttagacctaaccacctctggggctattatttgttccccgattgctacaatcaccactataagaagcccggctacaacggatcttgtttcaacgtcgaaattaaaagaaacgatgacctctcttggttgtggaatgagtctactgcactctacccctctatatatctcaacacacagcagtccccagtagccgctaccctctacgttcggaatagagtgagggaagccatcagggtgtccaagatccccgatgccaaatctcccctcccagtgtttgcctacaccaggatcgtgtttaccgaccaggtgttgaagttcctgagccaggacgagctcgtgtatacttttggcgagacagttgctctgggagcctctgggatcgtgatctggggcactctgagtattatgcgatcaatgaagtcctgcctgctgttggataactacatggagacaatcctgaacccatatatcattaacgtgactttggccgctaagatgtgttcacaggtgctgtgtcaagagcagggagtatgcattaggaagaactggaactcaagcgattatctccatctgaacccagataattttgcaatccagctggaaaagggtggtaaattcactgtccgagggaagcccacactcgaggatctcgaacagtttagtgaaaagttctactgtagctgctatagcactctgagttgtaaggaaaaagccgatgtgaaagacactgatgccgttgacgtttgcatcgccgatggggtgtgtattgacgcctttctcaagccaccaatgtgataaggatcc

SEQ ID NO: 170 - DNA, 1395 bp, Artificial Sequence
  SPAM1-LKPP codon optimized DNA with NheI and BamHI restriction sites
gctagcatggacatgagggtaccagcccagctgttgggccttcttctgctttggctccctggggcaaggggacttaacttcagagctccccctgtaatcccaaacgtccccttcctgtgggcatggaacgcccctagcgaattctgtttggggaaatttgacgaacctctggacatgtctctgttttcttttatcggtagccctcgaatcaacgctaccggacagggggtgacaatcttttacgtggatcgtctgggctattacccttacatcgacagcattactggggtgaccgtgaacggaggcattcctcagaaaatatcactgcaggaccacctggacaaagctaagaaggatattacattctacatgccagtggacaatctcggaatggctgtgattgactgggaggagtggagacctacttgggcccgaaattggaagcccaaggatgtgtataagaaccgatccattgagctggtgcagcagcagaacgtgcagctgtcccttacagaagccaccgaaaaagctaagcaggaattcgagaaagctgggaaggatttcctggttgagacaataaaacttgggaaactgcttagacctaaccacctctggggctattatttgttccccgattgctacaatcaccactataagaagcccggctacaacggatcttgtttcaacgtcgaaattaaaagaaacgatgacctctcttggttgtggaatgagtctactgcactctacccctctatatatctcaacacacagcagtccccagtagccgctaccctctacgttcggaatagagtgagggaagccatcagggtgtccaagatccccgatgccaaatctcccctcccagtgtttgcctacaccaggatcgtgtttaccgaccaggtgttgaagttcctgagccaggacgagctcgtgtatacttttggcgagacagttgctctgggagcctctgggatcgtgatctggggcactctgagtattatgcgatcaatgaagtcctgcctgctgttggataactacatggagacaatcctgaacccatatatcattaacgtgactttggccgctaagatgtgttcacaggtgctgtgtcaagagcagggagtatgcattaggaagaactggaactcaagcgattatctccatctgaacccagataattttgcaatccagctggaaaagggtggtaaattcactgtccgagggaagcccacactcgaggatctcgaacagtttagtgaaaagttctactgtagctgctatagcactctgagttgtaaggaaaaagccgatgtgaaagacactgatgccgttgacgtttgcatcgccgatggggtgtgtattgacgcctttctcaagccaccatgataaggatcc

SEQ ID NO: 171 - DNA, 1392 bp, Artificial Sequence
  SPAM1-FLKP codon optimized DNA with NheI and BamHI restriction sites
gctagcatggacatgagggtaccagcccagctgttgggccttcttctgctttggctccctggggcaaggggacttaacttcagagctccccctgtaatcccaaacgtccccttcctgtgggcatggaacgcccctagcgaattctgtttggggaaatttgacgaacctctggacatgtctctgttttcttttatcggtagccctcgaatcaacgctaccggacagggggtgacaatcttttacgtggatcgtctgggctattacccttacatcgacagcattactggggtgaccgtgaacggaggcattcctcagaaaatatcactgcaggaccacctggacaaagctaagaaggatattacattctacatgccagtggacaatctcggaatggctgtgattgactgggaggagtggagacctacttgggcccgaaattggaagcccaaggatgtgtataagaaccgatccattgagctggtgcagcagcagaacgtgcagctgtcccttacagaagccaccgaaaaagctaagcaggaattcgagaaagctgggaaggatttcctggttgagacaataaaacttgggaaactgcttagacctaaccacctctggggctattatttgttccccgattgctacaatcaccactataagaagcccggctacaacggatcttgtttcaacgtcgaaattaaaagaaacgatgacctctcttggttgtggaatgagtctactgcactctacccctctatatatctcaacacacagcagtccccagtagccgctaccctctacgttcggaatagagtgagggaagccatcagggtgtccaagatccccgatgccaaatctcccctcccagtgtttgcctacaccaggatcgtgtttaccgaccaggtgttgaagttcctgagccaggacgagctcgtgtatacttttggcgagacagttgctctgggagcctctgggatcgtgatctggggcactctgagtattatgcgatcaatgaagtcctgcctgctgttggataactacatggagacaatcctgaacccatatatcattaacgtgactttggccgctaagatgtgttcacaggtgctgtgtcaagagcagggagtatgcattaggaagaactggaactcaagcgattatctccatctgaacccagataattttgcaatccagctggaaaagggtggtaaattcactgtccgagggaagcccacactcgaggatctcgaacagtttagtgaaaagttctactgtagctgctatagcactctgagttgtaaggaaaaagccgatgtgaaagacactgatgccgttgacgtttgcatcgccgatggggtgtgtattgacgcctttctcaagccatgataaggatcc

SEQ ID NO: 172 - DNA, 1389 bp, Artificial Sequence
  SPAM1-AFLK codon optimized DNA with NheI and BamHI restriction sites
gctagcatggacatgagggtaccagcccagctgttgggccttcttctgctttggctccctggggcaaggggacttaacttcagagctccccctgtaatcccaaacgtccccttcctgtgggcatggaacgcccctagcgaattctgtttggggaaatttgacgaacctctggacatgtctctgttttcttttatcggtagccctcgaatcaacgctaccggacagggggtgacaatcttttacgtggatcgtctgggctattacccttacatcgacagcattactggggtgaccgtgaacggaggcattcctcagaaaatatcactgcaggaccacctggacaaagctaagaaggatattacattctacatgccagtggacaatctcggaatggctgtgattgactgggaggagtggagacctacttgggcccgaaattggaagcccaaggatgtgtataagaaccgatccattgagctggtgcagcagcagaacgtgcagctgtcccttacagaagccaccgaaaaagctaagcaggaattcgagaaagctgggaaggatttcctggttgagacaataaaacttgggaaactgcttagacctaaccacctctggggctattatttgttccccgattgctacaatcaccactataagaagcccggctacaacggatcttgtttcaacgtcgaaattaaaagaaacgatgacctctcttggttgtggaatgagtctactgcactctacccctctatatatctcaacacacagcagtccccagtagccgctaccctctacgttcggaatagagtgagggaagccatcagggtgtccaagatccccgatgccaaatctcccctcccagtgtttgcctacaccaggatcgtgtttaccgaccaggtgttgaagttcctgagccaggacgagctcgtgtatacttttggcgagacagttgctctgggagcctctgggatcgtgatctggggcactctgagtattatgcgatcaatgaagtcctgcctgctgttggataactacatggagacaatcctgaacccatatatcattaacgtgactttggccgctaagatgtgttcacaggtgctgtgtcaagagcagggagtatgcattaggaagaactggaactcaagcgattatctccatctgaacccagataattttgcaatccagctggaaaagggtggtaaattcactgtccgagggaagcccacactcgaggatctcgaacagtttagtgaaaagttctactgtagctgctatagcactctgagttgtaaggaaaaagccgatgtgaaagacactgatgccgttgacgtttgcatcgccgatggggtgtgtattgacgcctttctcaagtgataaggatcc

SEQ ID NO: 173 - DNA, 1386 bp, Artificial Sequence
  SPAM1-DAFL codon optimized DNA with NheI and BamHI restriction sites
gctagcatggacatgagggtaccagcccagctgttgggccttcttctgctttggctccctggggcaaggggacttaacttcagagctccccctgtaatcccaaacgtccccttcctgtgggcatggaacgcccctagcgaattctgtttggggaaatttgacgaacctctggacatgtctctgttttcttttatcggtagccctcgaatcaacgctaccggacagggggtgacaatcttttacgtggatcgtctgggctattacccttacatcgacagcattactggggtgaccgtgaacggaggcattcctcagaaaatatcactgcaggaccacctggacaaagctaagaaggatattacattctacatgccagtggacaatctcggaatggctgtgattgactgggaggagtggagacctacttgggcccgaaattggaagcccaaggatgtgtataagaaccgatccattgagctggtgcagcagcagaacgtgcagctgtcccttacagaagccaccgaaaaagctaagcaggaattcgagaaagctgggaaggatttcctggttgagacaataaaacttgggaaactgcttagacctaaccacctctggggctattatttgttccccgattgctacaatcaccactataagaagcccggctacaacggatcttgtttcaacgtcgaaattaaaagaaacgatgacctctcttggttgtggaatgagtctactgcactctacccctctatatatctcaacacacagcagtccccagtagccgctaccctctacgttcggaatagagtgagggaagccatcagggtgtccaagatccccgatgccaaatctcccctcccagtgtttgcctacaccaggatcgtgtttaccgaccaggtgttgaagttcctgagccaggacgagctcgtgtatacttttggcgagacagttgctctgggagcctctgggatcgtgatctggggcactctgagtattatgcgatcaatgaagtcctgcctgctgttggataactacatggagacaatcctgaacccatatatcattaacgtgactttggccgctaagatgtgttcacaggtgctgtgtcaagagcagggagtatgcattaggaagaactggaactcaagcgattatctccatctgaacccagataattttgcaatccagctggaaaagggtggtaaattcactgtccgagggaagcccacactcgaggatctcgaacagtttagtgaaaagttctactgtagctgctatagcactctgagttgtaaggaaaaagccgatgtgaaagacactgatgccgttgacgtttgcatcgccgatggggtgtgtattgacgcctttctctgataaggatcc

SEQ ID NO: 174 - DNA, 1383 bp, Artificial Sequence
  SPAM1-IDAF codon optimized DNA with NheI and BamHI restriction sites
gctagcatggacatgagggtaccagcccagctgttgggccttcttctgctttggctccctggggcaaggggacttaacttcagagctccccctgtaatcccaaacgtccccttcctgtgggcatggaacgcccctagcgaattctgtttggggaaatttgacgaacctctggacatgtctctgttttcttttatcggtagccctcgaatcaacgctaccggacagggggtgacaatcttttacgtggatcgtctgggctattacccttacatcgacagcattactggggtgaccgtgaacggaggcattcctcagaaaatatcactgcaggaccacctggacaaagctaagaaggatattacattctacatgccagtggacaatctcggaatggctgtgattgactgggaggagtggagacctacttgggcccgaaattggaagcccaaggatgtgtataagaaccgatccattgagctggtgcagcagcagaacgtgcagctgtcccttacagaagccaccgaaaaagctaagcaggaattcgagaaagctgggaaggatttcctggttgagacaataaaacttgggaaactgcttagacctaaccacctctggggctattatttgttccccgattgctacaatcaccactataagaagcccggctacaacggatcttgtttcaacgtcgaaattaaaagaaacgatgacctctcttggttgtggaatgagtctactgcactctacccctctatatatctcaacacacagcagtccccagtagccgctaccctctacgttcggaatagagtgagggaagccatcagggtgtccaagatccccgatgccaaatctcccctcccagtgtttgcctacaccaggatcgtgtttaccgaccaggtgttgaagttcctgagccaggacgagctcgtgtatacttttggcgagacagttgctctgggagcctctgggatcgtgatctggggcactctgagtattatgcgatcaatgaagtcctgcctgctgttggataactacatggagacaatcctgaacccatatatcattaacgtgactttggccgctaagatgtgttcacaggtgctgtgtcaagagcagggagtatgcattaggaagaactggaactcaagcgattatctccatctgaacccagataattttgcaatccagctggaaaagggtggtaaattcactgtccgagggaagcccacactcgaggatctcgaacagtttagtgaaaagttctactgtagctgctatagcactctgagttgtaaggaaaaagccgatgtgaaagacactgatgccgttgacgtttgcatcgccgatggggtgtgtattgacgccttttgataaggatcc

SEQ ID NO: 175 - DNA, 1380 bp, Artificial Sequence
  SPAM1-CIDA codon optimized DNA with NheI and BamHI restriction sites
gctagcatggacatgagggtaccagcccagctgttgggccttcttctgctttggctccctggggcaaggggacttaacttcagagctccccctgtaatcccaaacgtccccttcctgtgggcatggaacgcccctagcgaattctgtttggggaaatttgacgaacctctggacatgtctctgttttcttttatcggtagccctcgaatcaacgctaccggacagggggtgacaatcttttacgtggatcgtctgggctattacccttacatcgacagcattactggggtgaccgtgaacggaggcattcctcagaaaatatcactgcaggaccacctggacaaagctaagaaggatattacattctacatgccagtggacaatctcggaatggctgtgattgactgggaggagtggagacctacttgggcccgaaattggaagcccaaggatgtgtataagaaccgatccattgagctggtgcagcagcagaacgtgcagctgtcccttacagaagccaccgaaaaagctaagcaggaattcgagaaagctgggaaggatttcctggttgagacaataaaacttgggaaactgcttagacctaaccacctctggggctattatttgttccccgattgctacaatcaccactataagaagcccggctacaacggatcttgtttcaacgtcgaaattaaaagaaacgatgacctctcttggttgtggaatgagtctactgcactctacccctctatatatctcaacacacagcagtccccagtagccgctaccctctacgttcggaatagagtgagggaagccatcagggtgtccaagatccccgatgccaaatctcccctcccagtgtttgcctacaccaggatcgtgtttaccgaccaggtgttgaagttcctgagccaggacgagctcgtgtatacttttggcgagacagttgctctgggagcctctgggatcgtgatctggggcactctgagtattatgcgatcaatgaagtcctgcctgctgttggataactacatggagacaatcctgaacccatatatcattaacgtgactttggccgctaagatgtgttcacaggtgctgtgtcaagagcagggagtatgcattaggaagaactggaactcaagcgattatctccatctgaacccagataattttgcaatccagctggaaaagggtggtaaattcactgtccgagggaagcccacactcgaggatctcgaacagtttagtgaaaagttctactgtagctgctatagcactctgagttgtaaggaaaaagccgatgtgaaagacactgatgccgttgacgtttgcatcgccgatggggtgtgtattgacgcctgataaggatcc

SEQ ID NO: 176 - DNA, 1377 bp, Artificial Sequence
  SPAM1-VCID codon optimized DNA with NheI and BamHI restriction sites
gctagcatggacatgagggtaccagcccagctgttgggccttcttctgctttggctccctggggcaaggggacttaacttcagagctccccctgtaatcccaaacgtccccttcctgtgggcatggaacgcccctagcgaattctgtttggggaaatttgacgaacctctggacatgtctctgttttcttttatcggtagccctcgaatcaacgctaccggacagggggtgacaatcttttacgtggatcgtctgggctattacccttacatcgacagcattactggggtgaccgtgaacggaggcattcctcagaaaatatcactgcaggaccacctggacaaagctaagaaggatattacattctacatgccagtggacaatctcggaatggctgtgattgactgggaggagtggagacctacttgggcccgaaattggaagcccaaggatgtgtataagaaccgatccattgagctggtgcagcagcagaacgtgcagctgtcccttacagaagccaccgaaaaagctaagcaggaattcgagaaagctgggaaggatttcctggttgagacaataaaacttgggaaactgcttagacctaaccacctctggggctattatttgttccccgattgctacaatcaccactataagaagcccggctacaacggatcttgtttcaacgtcgaaattaaaagaaacgatgacctctcttggttgtggaatgagtctactgcactctacccctctatatatctcaacacacagcagtccccagtagccgctaccctctacgttcggaatagagtgagggaagccatcagggtgtccaagatccccgatgccaaatctcccctcccagtgtttgcctacaccaggatcgtgtttaccgaccaggtgttgaagttcctgagccaggacgagctcgtgtatacttttggcgagacagttgctctgggagcctctgggatcgtgatctggggcactctgagtattatgcgatcaatgaagtcctgcctgctgttggataactacatggagacaatcctgaacccatatatcattaacgtgactttggccgctaagatgtgttcacaggtgctgtgtcaagagcagggagtatgcattaggaagaactggaactcaagcgattatctccatctgaacccagataattttgcaatccagctggaaaagggtggtaaattcactgtccgagggaagcccacactcgaggatctcgaacagtttagtgaaaagttctactgtagctgctatagcactctgagttgtaaggaaaaagccgatgtgaaagacactgatgccgttgacgtttgcatcgccgatggggtgtgtattgactgataaggatcc

SEQ ID NO: 177 - DNA, 1374 bp, Artificial Sequence
  SPAM1-GVCI codon optimized DNA with NheI and BamHI restriction sites
gctagcatggacatgagggtaccagcccagctgttgggccttcttctgctttggctccctggggcaaggggacttaacttcagagctccccctgtaatcccaaacgtccccttcctgtgggcatggaacgcccctagcgaattctgtttggggaaatttgacgaacctctggacatgtctctgttttcttttatcggtagccctcgaatcaacgctaccggacagggggtgacaatcttttacgtggatcgtctgggctattacccttacatcgacagcattactggggtgaccgtgaacggaggcattcctcagaaaatatcactgcaggaccacctggacaaagctaagaaggatattacattctacatgccagtggacaatctcggaatggctgtgattgactgggaggagtggagacctacttgggcccgaaattggaagcccaaggatgtgtataagaaccgatccattgagctggtgcagcagcagaacgtgcagctgtcccttacagaagccaccgaaaaagctaagcaggaattcgagaaagctgggaaggatttcctggttgagacaataaaacttgggaaactgcttagacctaaccacctctggggctattatttgttccccgattgctacaatcaccactataagaagcccggctacaacggatcttgtttcaacgtcgaaattaaaagaaacgatgacctctcttggttgtggaatgagtctactgcactctacccctctatatatctcaacacacagcagtccccagtagccgctaccctctacgttcggaatagagtgagggaagccatcagggtgtccaagatccccgatgccaaatctcccctcccagtgtttgcctacaccaggatcgtgtttaccgaccaggtgttgaagttcctgagccaggacgagctcgtgtatacttttggcgagacagttgctctgggagcctctgggatcgtgatctggggcactctgagtattatgcgatcaatgaagtcctgcctgctgttggataactacatggagacaatcctgaacccatatatcattaacgtgactttggccgctaagatgtgttcacaggtgctgtgtcaagagcagggagtatgcattaggaagaactggaactcaagcgattatctccatctgaacccagataattttgcaatccagctggaaaagggtggtaaattcactgtccgagggaagcccacactcgaggatctcgaacagtttagtgaaaagttctactgtagctgctatagcactctgagttgtaaggaaaaagccgatgtgaaagacactgatgccgttgacgtttgcatcgccgatggggtgtgtatttgataaggatcc

SEQ ID NO: 178 - DNA, 1371 bp, Artificial Sequence
  SPAM1-DGVC codon optimized DNA with NheI and BamHI restriction sites
gctagcatggacatgagggtaccagcccagctgttgggccttcttctgctttggctccctggggcaaggggacttaacttcagagctccccctgtaatcccaaacgtccccttcctgtgggcatggaacgcccctagcgaattctgtttggggaaatttgacgaacctctggacatgtctctgttttcttttatcggtagccctcgaatcaacgctaccggacagggggtgacaatcttttacgtggatcgtctgggctattacccttacatcgacagcattactggggtgaccgtgaacggaggcattcctcagaaaatatcactgcaggaccacctggacaaagctaagaaggatattacattctacatgccagtggacaatctcggaatggctgtgattgactgggaggagtggagacctacttgggcccgaaattggaagcccaaggatgtgtataagaaccgatccattgagctggtgcagcagcagaacgtgcagctgtcccttacagaagccaccgaaaaagctaagcaggaattcgagaaagctgggaaggatttcctggttgagacaataaaacttgggaaactgcttagacctaaccacctctggggctattatttgttccccgattgctacaatcaccactataagaagcccggctacaacggatcttgtttcaacgtcgaaattaaaagaaacgatgacctctcttggttgtggaatgagtctactgcactctacccctctatatatctcaacacacagcagtccccagtagccgctaccctctacgttcggaatagagtgagggaagccatcagggtgtccaagatccccgatgccaaatctcccctcccagtgtttgcctacaccaggatcgtgtttaccgaccaggtgttgaagttcctgagccaggacgagctcgtgtatacttttggcgagacagttgctctgggagcctctgggatcgtgatctggggcactctgagtattatgcgatcaatgaagtcctgcctgctgttggataactacatggagacaatcctgaacccatatatcattaacgtgactttggccgctaagatgtgttcacaggtgctgtgtcaagagcagggagtatgcattaggaagaactggaactcaagcgattatctccatctgaacccagataattttgcaatccagctggaaaagggtggtaaattcactgtccgagggaagcccacactcgaggatctcgaacagtttagtgaaaagttctactgtagctgctatagcactctgagttgtaaggaaaaagccgatgtgaaagacactgatgccgttgacgtttgcatcgccgatggggtgtgttgataaggatcc

SEQ ID NO: 179 - DNA, 1365 bp, Artificial Sequence
  SPAM1-IADG codon optimized DNA with NheI and BamHI restriction sites
gctagcatggacatgagggtaccagcccagctgttgggccttcttctgctttggctccctggggcaaggggacttaacttcagagctccccctgtaatcccaaacgtccccttcctgtgggcatggaacgcccctagcgaattctgtttggggaaatttgacgaacctctggacatgtctctgttttcttttatcggtagccctcgaatcaacgctaccggacagggggtgacaatcttttacgtggatcgtctgggctattacccttacatcgacagcattactggggtgaccgtgaacggaggcattcctcagaaaatatcactgcaggaccacctggacaaagctaagaaggatattacattctacatgccagtggacaatctcggaatggctgtgattgactgggaggagtggagacctacttgggcccgaaattggaagcccaaggatgtgtataagaaccgatccattgagctggtgcagcagcagaacgtgcagctgtcccttacagaagccaccgaaaaagctaagcaggaattcgagaaagctgggaaggatttcctggttgagacaataaaacttgggaaactgcttagacctaaccacctctggggctattatttgttccccgattgctacaatcaccactataagaagcccggctacaacggatcttgtttcaacgtcgaaattaaaagaaacgatgacctctcttggttgtggaatgagtctactgcactctacccctctatatatctcaacacacagcagtccccagtagccgctaccctctacgttcggaatagagtgagggaagccatcagggtgtccaagatccccgatgccaaatctcccctcccagtgtttgcctacaccaggatcgtgtttaccgaccaggtgttgaagttcctgagccaggacgagctcgtgtatacttttggcgagacagttgctctgggagcctctgggatcgtgatctggggcactctgagtattatgcgatcaatgaagtcctgcctgctgttggataactacatggagacaatcctgaacccatatatcattaacgtgactttggccgctaagatgtgttcacaggtgctgtgtcaagagcagggagtatgcattaggaagaactggaactcaagcgattatctccatctgaacccagataattttgcaatccagctggaaaagggtggtaaattcactgtccgagggaagcccacactcgaggatctcgaacagtttagtgaaaagttctactgtagctgctatagcactctgagttgtaaggaaaaagccgatgtgaaagacactgatgccgttgacgtttgcatcgccgatgggtgataaggatcc

SEQ ID NO: 180 - DNA, 1359 bp, Artificial Sequence
  SPAM1-VCIA codon optimized DNA with NheI and BamHI restriction sites
gctagcatggacatgagggtaccagcccagctgttgggccttcttctgctttggctccctggggcaaggggacttaacttcagagctccccctgtaatcccaaacgtccccttcctgtgggcatggaacgcccctagcgaattctgtttggggaaatttgacgaacctctggacatgtctctgttttcttttatcggtagccctcgaatcaacgctaccggacagggggtgacaatcttttacgtggatcgtctgggctattacccttacatcgacagcattactggggtgaccgtgaacggaggcattcctcagaaaatatcactgcaggaccacctggacaaagctaagaaggatattacattctacatgccagtggacaatctcggaatggctgtgattgactgggaggagtggagacctacttgggcccgaaattggaagcccaaggatgtgtataagaaccgatccattgagctggtgcagcagcagaacgtgcagctgtcccttacagaagccaccgaaaaagctaagcaggaattcgagaaagctgggaaggatttcctggttgagacaataaaacttgggaaactgcttagacctaaccacctctggggctattatttgttccccgattgctacaatcaccactataagaagcccggctacaacggatcttgtttcaacgtcgaaattaaaagaaacgatgacctctcttggttgtggaatgagtctactgcactctacccctctatatatctcaacacacagcagtccccagtagccgctaccctctacgttcggaatagagtgagggaagccatcagggtgtccaagatccccgatgccaaatctcccctcccagtgtttgcctacaccaggatcgtgtttaccgaccaggtgttgaagttcctgagccaggacgagctcgtgtatacttttggcgagacagttgctctgggagcctctgggatcgtgatctggggcactctgagtattatgcgatcaatgaagtcctgcctgctgttggataactacatggagacaatcctgaacccatatatcattaacgtgactttggccgctaagatgtgttcacaggtgctgtgtcaagagcagggagtatgcattaggaagaactggaactcaagcgattatctccatctgaacccagataattttgcaatccagctggaaaagggtggtaaattcactgtccgagggaagcccacactcgaggatctcgaacagtttagtgaaaagttctactgtagctgctatagcactctgagttgtaaggaaaaagccgatgtgaaagacactgatgccgttgacgtttgcatcgcctgataaggatcc

SEQ ID NO: 181 - DNA, 1353 bp, Artificial Sequence
  SPAM1-VDVC codon optimized DNA with NheI and BamHI restriction sites
gctagcatggacatgagggtaccagcccagctgttgggccttcttctgctttggctccctggggcaaggggacttaacttcagagctccccctgtaatcccaaacgtccccttcctgtgggcatggaacgcccctagcgaattctgtttggggaaatttgacgaacctctggacatgtctctgttttcttttatcggtagccctcgaatcaacgctaccggacagggggtgacaatcttttacgtggatcgtctgggctattacccttacatcgacagcattactggggtgaccgtgaacggaggcattcctcagaaaatatcactgcaggaccacctggacaaagctaagaaggatattacattctacatgccagtggacaatctcggaatggctgtgattgactgggaggagtggagacctacttgggcccgaaattggaagcccaaggatgtgtataagaaccgatccattgagctggtgcagcagcagaacgtgcagctgtcccttacagaagccaccgaaaaagctaagcaggaattcgagaaagctgggaaggatttcctggttgagacaataaaacttgggaaactgcttagacctaaccacctctggggctattatttgttccccgattgctacaatcaccactataagaagcccggctacaacggatcttgtttcaacgtcgaaattaaaagaaacgatgacctctcttggttgtggaatgagtctactgcactctacccctctatatatctcaacacacagcagtccccagtagccgctaccctctacgttcggaatagagtgagggaagccatcagggtgtccaagatccccgatgccaaatctcccctcccagtgtttgcctacaccaggatcgtgtttaccgaccaggtgttgaagttcctgagccaggacgagctcgtgtatacttttggcgagacagttgctctgggagcctctgggatcgtgatctggggcactctgagtattatgcgatcaatgaagtcctgcctgctgttggataactacatggagacaatcctgaacccatatatcattaacgtgactttggccgctaagatgtgttcacaggtgctgtgtcaagagcagggagtatgcattaggaagaactggaactcaagcgattatctccatctgaacccagataattttgcaatccagctggaaaagggtggtaaattcactgtccgagggaagcccacactcgaggatctcgaacagtttagtgaaaagttctactgtagctgctatagcactctgagttgtaaggaaaaagccgatgtgaaagacactgatgccgttgacgtttgctgataaggatcc

SEQ ID NO: 182 - DNA, 1347 bp, Artificial Sequence
  SPAM1-DAVD codon optimized DNA with NheI and BamHI restriction sites
gctagcatggacatgagggtaccagcccagctgttgggccttcttctgctttggctccctggggcaaggggacttaacttcagagctccccctgtaatcccaaacgtccccttcctgtgggcatggaacgcccctagcgaattctgtttggggaaatttgacgaacctctggacatgtctctgttttcttttatcggtagccctcgaatcaacgctaccggacagggggtgacaatcttttacgtggatcgtctgggctattacccttacatcgacagcattactggggtgaccgtgaacggaggcattcctcagaaaatatcactgcaggaccacctggacaaagctaagaaggatattacattctacatgccagtggacaatctcggaatggctgtgattgactgggaggagtggagacctacttgggcccgaaattggaagcccaaggatgtgtataagaaccgatccattgagctggtgcagcagcagaacgtgcagctgtcccttacagaagccaccgaaaaagctaagcaggaattcgagaaagctgggaaggatttcctggttgagacaataaaacttgggaaactgcttagacctaaccacctctggggctattatttgttccccgattgctacaatcaccactataagaagcccggctacaacggatcttgtttcaacgtcgaaattaaaagaaacgatgacctctcttggttgtggaatgagtctactgcactctacccctctatatatctcaacacacagcagtccccagtagccgctaccctctacgttcggaatagagtgagggaagccatcagggtgtccaagatccccgatgccaaatctcccctcccagtgtttgcctacaccaggatcgtgtttaccgaccaggtgttgaagttcctgagccaggacgagctcgtgtatacttttggcgagacagttgctctgggagcctctgggatcgtgatctggggcactctgagtattatgcgatcaatgaagtcctgcctgctgttggataactacatggagacaatcctgaacccatatatcattaacgtgactttggccgctaagatgtgttcacaggtgctgtgtcaagagcagggagtatgcattaggaagaactggaactcaagcgattatctccatctgaacccagataattttgcaatccagctggaaaagggtggtaaattcactgtccgagggaagcccacactcgaggatctcgaacagtttagtgaaaagttctactgtagctgctatagcactctgagttgtaaggaaaaagccgatgtgaaagacactgatgccgttgactgataaggatcc

SEQ ID NO: 183 - DNA, 1341 bp, Artificial Sequence
  SPAM1-DTDA codon optimized DNA with NheI and BamHI restriction sites
gctagcatggacatgagggtaccagcccagctgttgggccttcttctgctttggctccctggggcaaggggacttaacttcagagctccccctgtaatcccaaacgtccccttcctgtgggcatggaacgcccctagcgaattctgtttggggaaatttgacgaacctctggacatgtctctgttttcttttatcggtagccctcgaatcaacgctaccggacagggggtgacaatcttttacgtggatcgtctgggctattacccttacatcgacagcattactggggtgaccgtgaacggaggcattcctcagaaaatatcactgcaggaccacctggacaaagctaagaaggatattacattctacatgccagtggacaatctcggaatggctgtgattgactgggaggagtggagacctacttgggcccgaaattggaagcccaaggatgtgtataagaaccgatccattgagctggtgcagcagcagaacgtgcagctgtcccttacagaagccaccgaaaaagctaagcaggaattcgagaaagctgggaaggatttcctggttgagacaataaaacttgggaaactgcttagacctaaccacctctggggctattatttgttccccgattgctacaatcaccactataagaagcccggctacaacggatcttgtttcaacgtcgaaattaaaagaaacgatgacctctcttggttgtggaatgagtctactgcactctacccctctatatatctcaacacacagcagtccccagtagccgctaccctctacgttcggaatagagtgagggaagccatcagggtgtccaagatccccgatgccaaatctcccctcccagtgtttgcctacaccaggatcgtgtttaccgaccaggtgttgaagttcctgagccaggacgagctcgtgtatacttttggcgagacagttgctctgggagcctctgggatcgtgatctggggcactctgagtattatgcgatcaatgaagtcctgcctgctgttggataactacatggagacaatcctgaacccatatatcattaacgtgactttggccgctaagatgtgttcacaggtgctgtgtcaagagcagggagtatgcattaggaagaactggaactcaagcgattatctccatctgaacccagataattttgcaatccagctggaaaagggtggtaaattcactgtccgagggaagcccacactcgaggatctcgaacagtttagtgaaaagttctactgtagctgctatagcactctgagttgtaaggaaaaagccgatgtgaaagacactgatgcctgataaggatcc

SEQ ID NO: 184 - DNA, 1335 bp, Artificial Sequence
  SPAM1-VKDT codon optimized DNA with NheI and BamHI restriction sites
gctagcatggacatgagggtaccagcccagctgttgggccttcttctgctttggctccctggggcaaggggacttaacttcagagctccccctgtaatcccaaacgtccccttcctgtgggcatggaacgcccctagcgaattctgtttggggaaatttgacgaacctctggacatgtctctgttttcttttatcggtagccctcgaatcaacgctaccggacagggggtgacaatcttttacgtggatcgtctgggctattacccttacatcgacagcattactggggtgaccgtgaacggaggcattcctcagaaaatatcactgcaggaccacctggacaaagctaagaaggatattacattctacatgccagtggacaatctcggaatggctgtgattgactgggaggagtggagacctacttgggcccgaaattggaagcccaaggatgtgtataagaaccgatccattgagctggtgcagcagcagaacgtgcagctgtcccttacagaagccaccgaaaaagctaagcaggaattcgagaaagctgggaaggatttcctggttgagacaataaaacttgggaaactgcttagacctaaccacctctggggctattatttgttccccgattgctacaatcaccactataagaagcccggctacaacggatcttgtttcaacgtcgaaattaaaagaaacgatgacctctcttggttgtggaatgagtctactgcactctacccctctatatatctcaacacacagcagtccccagtagccgctaccctctacgttcggaatagagtgagggaagccatcagggtgtccaagatccccgatgccaaatctcccctcccagtgtttgcctacaccaggatcgtgtttaccgaccaggtgttgaagttcctgagccaggacgagctcgtgtatacttttggcgagacagttgctctgggagcctctgggatcgtgatctggggcactctgagtattatgcgatcaatgaagtcctgcctgctgttggataactacatggagacaatcctgaacccatatatcattaacgtgactttggccgctaagatgtgttcacaggtgctgtgtcaagagcagggagtatgcattaggaagaactggaactcaagcgattatctccatctgaacccagataattttgcaatccagctggaaaagggtggtaaattcactgtccgagggaagcccacactcgaggatctcgaacagtttagtgaaaagttctactgtagctgctatagcactctgagttgtaaggaaaaagccgatgtgaaagacacttgataaggatcc

SEQ ID NO: 185 - DNA, 1329 bp, Artificial Sequence
  SPAM1-ADVK codon optimized DNA with NheI and BamHI restriction sites
gctagcatggacatgagggtaccagcccagctgttgggccttcttctgctttggctccctggggcaaggggacttaacttcagagctccccctgtaatcccaaacgtccccttcctgtgggcatggaacgcccctagcgaattctgtttggggaaatttgacgaacctctggacatgtctctgttttcttttatcggtagccctcgaatcaacgctaccggacagggggtgacaatcttttacgtggatcgtctgggctattacccttacatcgacagcattactggggtgaccgtgaacggaggcattcctcagaaaatatcactgcaggaccacctggacaaagctaagaaggatattacattctacatgccagtggacaatctcggaatggctgtgattgactgggaggagtggagacctacttgggcccgaaattggaagcccaaggatgtgtataagaaccgatccattgagctggtgcagcagcagaacgtgcagctgtcccttacagaagccaccgaaaaagctaagcaggaattcgagaaagctgggaaggatttcctggttgagacaataaaacttgggaaactgcttagacctaaccacctctggggctattatttgttccccgattgctacaatcaccactataagaagcccggctacaacggatcttgtttcaacgtcgaaattaaaagaaacgatgacctctcttggttgtggaatgagtctactgcactctacccctctatatatctcaacacacagcagtccccagtagccgctaccctctacgttcggaatagagtgagggaagccatcagggtgtccaagatccccgatgccaaatctcccctcccagtgtttgcctacaccaggatcgtgtttaccgaccaggtgttgaagttcctgagccaggacgagctcgtgtatacttttggcgagacagttgctctgggagcctctgggatcgtgatctggggcactctgagtattatgcgatcaatgaagtcctgcctgctgttggataactacatggagacaatcctgaacccatatatcattaacgtgactttggccgctaagatgtgttcacaggtgctgtgtcaagagcagggagtatgcattaggaagaactggaactcaagcgattatctccatctgaacccagataattttgcaatccagctggaaaagggtggtaaattcactgtccgagggaagcccacactcgaggatctcgaacagtttagtgaaaagttctactgtagctgctatagcactctgagttgtaaggaaaaagccgatgtgaaatgataaggatcc

SEQ ID NO: 186 - protein, 35 aa, Homo sapiens
  PH20 signal peptide
MGVLKFKHIFFRSFVKSSGVSQIVFTFLLIPCCLT

SEQ ID NO: 187 - protein, 496 aa, Artificial Sequence
  PH20sHis
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPSTLSHHHHHH

SEQ ID NO: 188 - protein, 496 aa, Artificial Sequence
  PH20sHis-N368A (mut1)
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIIAVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPSTLSHHHHHH

SEQ ID NO: 189 - protein, 496 aa, Artificial Sequence
  PH20sHis-N393A (mut2)
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWASSDYLHLNPDNFAIQLEKGGKFTVRGKPTLEDLEQFSEKFYCSCYSTLSCKEKADVKDTDAVDVCIADGVCIDAFLKPPMETEEPQIFYNASPSTLSHHHHHH

SEQ ID NO: 190 - protein, 496 aa, Artificial Sequence
  PH20sHis-N368A/N393A (mut3)
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIIAVTLAAKMCSQVLCQEQGVCIRKNWASSDYLHLNPDNFAIQLEKGGKFTVRGKPTLEDLEQFSEKFYCSCYSTLSCKEKADVKDTDAVDVCIADGVCIDAFLKPPMETEEPQIFYNASPSTLSHHHHHH

SEQ ID NO: 191 - protein, 17 aa, Homo sapiens
  C-terminal peptide cleaved from rHuPH20 aa 431-447
DAFKLPPMETEEPQIFY

SEQ ID NO: 192 - protein, 16 aa, Homo sapiens
  C-terminal peptide cleaved from rHuPH20 aa 431-446
DAFKLPPMETEEPQIF

SEQ ID NO: 193 - protein, 15 aa, Homo sapiens
  C-terminal peptide cleaved from rHuPH20 aa 431-445
DAFKLPPMETEEPQI

SEQ ID NO: 194 - protein, 14 aa, Homo sapiens
  C-terminal peptide cleaved from rHuPH20 aa 431-444
DAFKLPPMETEEPQ

SEQ ID NO: 195 - protein, 13 aa, Homo sapiens
  C-terminal peptide cleaved from rHuPH20 aa 431-443
DAFKLPPMETEEP

SEQ ID NO: 196 - protein, 12 aa, Artificial Sequence
  C-terminal peptide cleaved from rHuPH20 aa 431-442
DAFKLPPMETEE

SEQ ID NO: 197 - protein, 510 aa, Pan troglodytes
  Chimpanzee PH20
MGVLKFKHIFFRSFVKSSGVSQIVFTFLLIPCCLTLNFRAPPVIPNVPFLWAWNAPSEFCLGKFDEPLDMSLFSFIGSPRINVTGQDVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVQEAIRVSKIPDAKSPLPVFVYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEESQIFYNASPSTLSATMFIDLCDLYLVPTSYLIL

SEQ ID NO: 198 - protein, 512 aa, Macaca mulatta
  Rhesus Monkey PH20
MGVLKFKHIFFRSFVKSSGVSQIVFTFLLIPCCLTLNFRAPPIIPNVPFLWAWNAPSEFCLGKFNEPLDMSLFTLMGSPRINITGQGVTIFYVDRLGYYPYIDLTTGVTVHGGIPQKVSLQDHLDKSKQDILFYMPVDNLGMAVIDWEEWRPTWARNWKPKDVYKNRSIELVQQQNVQLSLPQATDKAKQEFEKAGKDFMLETIKLGRSLRPNHLWGYYLFPDCYNHHYRKPGYNGSCFDVEIKRNDDLSWLWNESTALYPSIYLNTQQSVVVATLYVRNRVREAIRVSKIPDAKNPLPVFVYARLVFTDQVLKFLSREELVSTLGETVALGASGIVIWGSLSITRSMKSCLLLDTYMETILNPYIINVTLAAKMCSQVLCQEQGVCIRKDWNSSDYLHLNPDNFDIRLEKGGKFTVHGKPTVEDLEEFSEKFYCSCYTNLSCKEKADVKDTDAVDVCIADGVCIDASLKPPVETEGSPPIFYNTSSSTVSTTMFIWRLEVWDQGISRIGFF

SEQ ID NO: 199 - DNA, 1485 bp, Artificial Sequence
  SPAM1-LFLI codon optimized DNA with NheI and BamHI
gctagcatggacatgagggtaccagcccagctgttgggccttcttctgctttggctccctggggcaaggggacttaacttcagagctccccctgtaatcccaaacgtccccttcctgtgggcatggaacgcccctagcgaattctgtttggggaaatttgacgaacctctggacatgtctctgttttcttttatcggtagccctcgaatcaacgctaccggacagggggtgacaatcttttacgtggatcgtctgggctattacccttacatcgacagcattactggggtgaccgtgaacggaggcattcctcagaaaatatcactgcaggaccacctggacaaagctaagaaggatattacattctacatgccagtggacaatctcggaatggctgtgattgactgggaggagtggagacctacttgggcccgaaattggaagcccaaggatgtgtataagaaccgatccattgagctggtgcagcagcagaacgtgcagctgtcccttacagaagccaccgaaaaagctaagcaggaattcgagaaagctgggaaggatttcctggttgagacaataaaacttgggaaactgcttagacctaaccacctctggggctattatttgttccccgattgctacaatcaccactataagaagcccggctacaacggatcttgtttcaacgtcgaaattaaaagaaacgatgacctctcttggttgtggaatgagtctactgcactctacccctctatatatctcaacacacagcagtccccagtagccgctaccctctacgttcggaatagagtgagggaagccatcagggtgtccaagatccccgatgccaaatctcccctcccagtgtttgcctacaccaggatcgtgtttaccgaccaggtgttgaagttcctgagccaggacgagctcgtgtatacttttggcgagacagttgctctgggagcctctgggatcgtgatctggggcactctgagtattatgcgatcaatgaagtcctgcctgctgttggataactacatggagacaatcctgaacccatatatcattaacgtgactttggccgctaagatgtgttcacaggtgctgtgtcaagagcagggagtatgcattaggaagaactggaactcaagcgattatctccatctgaacccagataattttgcaatccagctggaaaagggtggtaaattcactgtccgagggaagcccacactcgaggatctcgaacagtttagtgaaaagttctactgtagctgctatagcactctgagttgtaaggaaaaagccgatgtgaaagacactgatgccgttgacgtttgcatcgccgatggggtgtgtattgacgcctttctcaagccaccaatggagactgaggagccccagatcttttacaacgcctccccctccaccttgagtgctaccatgttcatcgtatctatacttttcctgatttgataaggatcc

SEQ ID NO: 200 - DNA, 1479 bp, Artificial Sequence
  SPAM1-SILF codon optimized DNA with NheI and BamHI
gctagcatggacatgagggtaccagcccagctgttgggccttcttctgctttggctccctggggcaaggggacttaacttcagagctccccctgtaatcccaaacgtccccttcctgtgggcatggaacgcccctagcgaattctgtttggggaaatttgacgaacctctggacatgtctctgttttcttttatcggtagccctcgaatcaacgctaccggacagggggtgacaatcttttacgtggatcgtctgggctattacccttacatcgacagcattactggggtgaccgtgaacggaggcattcctcagaaaatatcactgcaggaccacctggacaaagctaagaaggatattacattctacatgccagtggacaatctcggaatggctgtgattgactgggaggagtggagacctacttgggcccgaaattggaagcccaaggatgtgtataagaaccgatccattgagctggtgcagcagcagaacgtgcagctgtcccttacagaagccaccgaaaaagctaagcaggaattcgagaaagctgggaaggatttcctggttgagacaataaaacttgggaaactgcttagacctaaccacctctggggctattatttgttccccgattgctacaatcaccactataagaagcccggctacaacggatcttgtttcaacgtcgaaattaaaagaaacgatgacctctcttggttgtggaatgagtctactgcactctacccctctatatatctcaacacacagcagtccccagtagccgctaccctctacgttcggaatagagtgagggaagccatcagggtgtccaagatccccgatgccaaatctcccctcccagtgtttgcctacaccaggatcgtgtttaccgaccaggtgttgaagttcctgagccaggacgagctcgtgtatacttttggcgagacagttgctctgggagcctctgggatcgtgatctggggcactctgagtattatgcgatcaatgaagtcctgcctgctgttggataactacatggagacaatcctgaacccatatatcattaacgtgactttggccgctaagatgtgttcacaggtgctgtgtcaagagcagggagtatgcattaggaagaactggaactcaagcgattatctccatctgaacccagataattttgcaatccagctggaaaagggtggtaaattcactgtccgagggaagcccacactcgaggatctcgaacagtttagtgaaaagttctactgtagctgctatagcactctgagttgtaaggaaaaagccgatgtgaaagacactgatgccgttgacgtttgcatcgccgatggggtgtgtattgacgcctttctcaagccaccaatggagactgaggagccccagatcttttacaacgcctccccctccaccttgagtgctaccatgttcatcgtatctatacttttctgataaggatcc

SEQ ID NO: 201 - DNA, 1473 bp, Artificial Sequence
  SPAM1-IVSI codon optimized DNA with NheI and BamHI
gctagcatggacatgagggtaccagcccagctgttgggccttcttctgctttggctccctggggcaaggggacttaacttcagagctccccctgtaatcccaaacgtccccttcctgtgggcatggaacgcccctagcgaattctgtttggggaaatttgacgaacctctggacatgtctctgttttcttttatcggtagccctcgaatcaacgctaccggacagggggtgacaatcttttacgtggatcgtctgggctattacccttacatcgacagcattactggggtgaccgtgaacggaggcattcctcagaaaatatcactgcaggaccacctggacaaagctaagaaggatattacattctacatgccagtggacaatctcggaatggctgtgattgactgggaggagtggagacctacttgggcccgaaattggaagcccaaggatgtgtataagaaccgatccattgagctggtgcagcagcagaacgtgcagctgtcccttacagaagccaccgaaaaagctaagcaggaattcgagaaagctgggaaggatttcctggttgagacaataaaacttgggaaactgcttagacctaaccacctctggggctattatttgttccccgattgctacaatcaccactataagaagcccggctacaacggatcttgtttcaacgtcgaaattaaaagaaacgatgacctctcttggttgtggaatgagtctactgcactctacccctctatatatctcaacacacagcagtccccagtagccgctaccctctacgttcggaatagagtgagggaagccatcagggtgtccaagatccccgatgccaaatctcccctcccagtgtttgcctacaccaggatcgtgtttaccgaccaggtgttgaagttcctgagccaggacgagctcgtgtatacttttggcgagacagttgctctgggagcctctgggatcgtgatctggggcactctgagtattatgcgatcaatgaagtcctgcctgctgttggataactacatggagacaatcctgaacccatatatcattaacgtgactttggccgctaagatgtgttcacaggtgctgtgtcaagagcagggagtatgcattaggaagaactggaactcaagcgattatctccatctgaacccagataattttgcaatccagctggaaaagggtggtaaattcactgtccgagggaagcccacactcgaggatctcgaacagtttagtgaaaagttctactgtagctgctatagcactctgagttgtaaggaaaaagccgatgtgaaagacactgatgccgttgacgtttgcatcgccgatggggtgtgtattgacgcctttctcaagccaccaatggagactgaggagccccagatcttttacaacgcctccccctccaccttgagtgctaccatgttcatcgtatctatatgataaggatcc

SEQ ID NO: 202 - protein, 496 aa, Artificial Sequence
  PH20sHis N82A
MGVLKFKHIFFRSFVKSSGVSQIVFTFLLIPCCLTLNFRAPPVIPNVPFLWAWNAPSEFCLGKFDEPLDMSLFSFIGSPRIAATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPSTLSHHHHHH

SEQ ID NO: 203 - protein, 496 aa, Artificial Sequence
  PH20sHis N166A
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKARSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPSTLSHHHHHH

SEQ ID NO: 204 - protein, 496 aa, Artificial Sequence
  PH20sHis N235A
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYAGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPSTLSHHHHHH

SEQ ID NO: 205 - protein, 496 aa, Artificial Sequence
  PH20sHis N254A
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWAESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPSTLSHHHHHH

SEQ ID NO: 206 - protein, 496 aa, Artificial Sequence
  PH20sHis N82A/N166A
MGVLKFKHIFFRSFVKSSGVSQIVFTFLLIPCCLTLNFRAPPVIPNVPFLWAWNAPSEFCLGKFDEPLDMSLFSFIGSPRIAATGQGVTIFYVDRLGYYPYIDSITGVTVNGGIPQKISLQDHLDKAKKDITFYMPVDNLGMAVIDWEEWRPTWARNWKPKDVYKARSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPSTLSHHHHHH

SEQ ID NO: 207 - protein, 496 aa, Artificial Sequence
  PH20sHis N82A/N254A
MGVLKFKHIFFRSFVKSSGVSQIVFTFLLIPCCLTLNFRAPPVIPNVPFLWAWNAPSEFCLGKFDEPLDMSLFSFIGSPRIAATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWAESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPSTLSHHHHHH

SEQ ID NO: 208 - protein, 496 aa, Artificial Sequence
  PH20sHis N166A/N254A
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKARSIELVQQQNVQLSLTEATEKAKQEFEKAGKDFLVETIKLGKLLRPNHLWGYYLFPDCYNHHYKKPGYNGSCFNVEIKRNDDLSWLWAESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPSTLSHHHHHH

SEQ ID NO: 209 - protein, 496 aa, Artificial Sequence
  PH20sHis N82A/N166A/N254A
MGVLKFKHIFFRSFVKSSGVSQIVFTFLLIPCCLTLNFRAPPVIPNVPFLWAWNAPSEFCLGKFDEPLDMSLFSFIGSPRIAATGQGVTIFYVDRLGYYPYIDSITGVTVNGGIPQKISLQDHLDKAKKDITFYMPVDNLGMAVIDWEEWRPTWARNWKPKDVYKARSIELVQQQNVQLSLTEATEKAKQEFEKAGKDFLVETIKLGKLLRPNHLWGYYLFPDCYNHHYKKPGYNGSCFNVEIKRNDDLSWLWAESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPSTLSHHHHHH

SEQ ID NO: 210 - DNA, 1494 bp, Artificial Sequence
  PH20sHis DNA
atgggagtgctaaaattcaagcacatctttttcagaagctttgttaaatcaagtggagtatcccagatagttttcaccttccttctgattccatgttgcttgactcttaacttcagagctccccctgtaatcccaaacgtccccttcctgtgggcatggaacgcccctagcgaattctgtttggggaaatttgacgaacctctggacatgtctctgttttcttttatcggtagccctcgaatcaacgctaccggacagggggtgacaatcttttacgtggatcgtctgggctattacccttacatcgacagcattactggggtgaccgtgaacggaggcattcctcagaaaatatcactgcaggaccacctggacaaagctaagaaggatattacattctacatgccagtggacaatctcggaatggctgtgattgactgggaggagtggagacctacttgggcccgaaattggaagcccaaggatgtgtataagaaccgatccattgagctggtgcagcagcagaacgtgcagctgtcccttacagaagccaccgaaaaagctaagcaggaattcgagaaagctgggaaggatttcctggttgagacaataaaacttgggaaactgcttagacctaaccacctctggggctattatttgttccccgattgctacaatcaccactataagaagcccggctacaacggatcttgtttcaacgtcgaaattaaaagaaacgatgacctctcttggttgtggaatgagtctactgcactctacccctctatatatctcaacacacagcagtccccagtagccgctaccctctacgttcggaatagagtgagggaagccatcagggtgtccaagatccccgatgccaaatctcccctcccagtgtttgcctacaccaggatcgtgtttaccgaccaggtgttgaagttcctgagccaggacgagctcgtgtatacttttggcgagacagttgctctgggagcctctgggatcgtgatctggggcactctgagtattatgcgatcaatgaagtcctgcctgctgttggataactacatggagacaatcctgaacccatatatcattaacgtgactttggccgctaagatgtgttcacaggtgctgtgtcaagagcagggagtatgcattaggaagaactggaactcaagcgattatctccatctgaacccagataattttgcaatccagctggaaaagggtggtaaattcactgtccgagggaagcccacactcgaggatctcgaacagtttagtgaaaagttctactgtagctgctatagcactctgagttgtaaggaaaaagccgatgtgaaagacactgatgccgttgacgtttgcatcgccgatggggtgtgtattgacgcctttctcaagccaccaatggagactgaggagccccagatcttttacaacgcctccccctccaccttgagtcatcatcatcatcatcattagtaa

SEQ ID NO: 211 - DNA, 1497 bp, Artificial Sequence
  SPAM1-ISSV
gctagcatggacatgagggtaccagcccagctgttgggccttcttctgctttggctccctggggcaaggggacttaacttcagagctccccctgtaatcccaaacgtccccttcctgtgggcatggaacgcccctagcgaattctgtttggggaaatttgacgaacctctggacatgtctctgttttcttttatcggtagccctcgaatcaacgctaccggacagggggtgacaatcttttacgtggatcgtctgggctattacccttacatcgacagcattactggggtgaccgtgaacggaggcattcctcagaaaatatcactgcaggaccacctggacaaagctaagaaggatattacattctacatgccagtggacaatctcggaatggctgtgattgactgggaggagtggagacctacttgggcccgaaattggaagcccaaggatgtgtataagaaccgatccattgagctggtgcagcagcagaacgtgcagctgtcccttacagaagccaccgaaaaagctaagcaggaattcgagaaagctgggaaggatttcctggttgagacaataaaacttgggaaactgcttagacctaaccacctctggggctattatttgttccccgattgctacaatcaccactataagaagcccggctacaacggatcttgtttcaacgtcgaaattaaaagaaacgatgacctctcttggttgtggaatgagtctactgcactctacccctctatatatctcaacacacagcagtccccagtagccgctaccctctacgttcggaatagagtgagggaagccatcagggtgtccaagatccccgatgccaaatctcccctcccagtgtttgcctacaccaggatcgtgtttaccgaccaggtgttgaagttcctgagccaggacgagctcgtgtatacttttggcgagacagttgctctgggagcctctgggatcgtgatctggggcactctgagtattatgcgatcaatgaagtcctgcctgctgttggataactacatggagacaatcctgaacccatatatcattaacgtgactttggccgctaagatgtgttcacaggtgctgtgtcaagagcagggagtatgcattaggaagaactggaactcaagcgattatctccatctgaacccagataattttgcaatccagctggaaaagggtggtaaattcactgtccgagggaagcccacactcgaggatctcgaacagtttagtgaaaagttctactgtagctgctatagcactctgagttgtaaggaaaaagccgatgtgaaagacactgatgccgttgacgtttgcatcgccgatggggtgtgtattgacgcctttctcaagccaccaatggagactgaggagccccagatcttttacaacgcctccccctccaccttgagtgctaccatgttcatcgtatctatacttttcctgattatatcaagcgtgtgataaggatcc

SEQ ID NO: 212 - DNA, 1491 bp, Artificial Sequence
  SPAM1-LIIS
gctagcatggacatgagggtaccagcccagctgttgggccttcttctgctttggctccctggggcaaggggacttaacttcagagctccccctgtaatcccaaacgtccccttcctgtgggcatggaacgcccctagcgaattctgtttggggaaatttgacgaacctctggacatgtctctgttttcttttatcggtagccctcgaatcaacgctaccggacagggggtgacaatcttttacgtggatcgtctgggctattacccttacatcgacagcattactggggtgaccgtgaacggaggcattcctcagaaaatatcactgcaggaccacctggacaaagctaagaaggatattacattctacatgccagtggacaatctcggaatggctgtgattgactgggaggagtggagacctacttgggcccgaaattggaagcccaaggatgtgtataagaaccgatccattgagctggtgcagcagcagaacgtgcagctgtcccttacagaagccaccgaaaaagctaagcaggaattcgagaaagctgggaaggatttcctggttgagacaataaaacttgggaaactgcttagacctaaccacctctggggctattatttgttccccgattgctacaatcaccactataagaagcccggctacaacggatcttgtttcaacgtcgaaattaaaagaaacgatgacctctcttggttgtggaatgagtctactgcactctacccctctatatatctcaacacacagcagtccccagtagccgctaccctctacgttcggaatagagtgagggaagccatcagggtgtccaagatccccgatgccaaatctcccctcccagtgtttgcctacaccaggatcgtgtttaccgaccaggtgttgaagttcctgagccaggacgagctcgtgtatacttttggcgagacagttgctctgggagcctctgggatcgtgatctggggcactctgagtattatgcgatcaatgaagtcctgcctgctgttggataactacatggagacaatcctgaacccatatatcattaacgtgactttggccgctaagatgtgttcacaggtgctgtgtcaagagcagggagtatgcattaggaagaactggaactcaagcgattatctccatctgaacccagataattttgcaatccagctggaaaagggtggtaaattcactgtccgagggaagcccacactcgaggatctcgaacagtttagtgaaaagttctactgtagctgctatagcactctgagttgtaaggaaaaagccgatgtgaaagacactgatgccgttgacgtttgcatcgccgatggggtgtgtattgacgcctttctcaagccaccaatggagactgaggagccccagatcttttacaacgcctccccctccaccttgagtgctaccatgttcatcgtatctatacttttcctgattatatcatgataaggatcc

SEQ ID NO: 213 - DNA, 1467 bp, Artificial Sequence
  SPAM1-MFIV
gctagcatggacatgagggtaccagcccagctgttgggccttcttctgctttggctccctggggcaaggggacttaacttcagagctccccctgtaatcccaaacgtccccttcctgtgggcatggaacgcccctagcgaattctgtttggggaaatttgacgaacctctggacatgtctctgttttcttttatcggtagccctcgaatcaacgctaccggacagggggtgacaatcttttacgtggatcgtctgggctattacccttacatcgacagcattactggggtgaccgtgaacggaggcattcctcagaaaatatcactgcaggaccacctggacaaagctaagaaggatattacattctacatgccagtggacaatctcggaatggctgtgattgactgggaggagtggagacctacttgggcccgaaattggaagcccaaggatgtgtataagaaccgatccattgagctggtgcagcagcagaacgtgcagctgtcccttacagaagccaccgaaaaagctaagcaggaattcgagaaagctgggaaggatttcctggttgagacaataaaacttgggaaactgcttagacctaaccacctctggggctattatttgttccccgattgctacaatcaccactataagaagcccggctacaacggatcttgtttcaacgtcgaaattaaaagaaacgatgacctctcttggttgtggaatgagtctactgcactctacccctctatatatctcaacacacagcagtccccagtagccgctaccctctacgttcggaatagagtgagggaagccatcagggtgtccaagatccccgatgccaaatctcccctcccagtgtttgcctacaccaggatcgtgtttaccgaccaggtgttgaagttcctgagccaggacgagctcgtgtatacttttggcgagacagttgctctgggagcctctgggatcgtgatctggggcactctgagtattatgcgatcaatgaagtcctgcctgctgttggataactacatggagacaatcctgaacccatatatcattaacgtgactttggccgctaagatgtgttcacaggtgctgtgtcaagagcagggagtatgcattaggaagaactggaactcaagcgattatctccatctgaacccagataattttgcaatccagctggaaaagggtggtaaattcactgtccgagggaagcccacactcgaggatctcgaacagtttagtgaaaagttctactgtagctgctatagcactctgagttgtaaggaaaaagccgatgtgaaagacactgatgccgttgacgtttgcatcgccgatggggtgtgtattgacgcctttctcaagccaccaatggagactgaggagccccagatcttttacaacgcctccccctccaccttgagtgctaccatgttcatcgtatgataaggatcc

SEQ ID NO: 214 - DNA, 1461 bp, Artificial Sequence
  SPAM1-ATMF
gctagcatggacatgagggtaccagcccagctgttgggccttcttctgctttggctccctggggcaaggggacttaacttcagagctccccctgtaatcccaaacgtccccttcctgtgggcatggaacgcccctagcgaattctgtttggggaaatttgacgaacctctggacatgtctctgttttcttttatcggtagccctcgaatcaacgctaccggacagggggtgacaatcttttacgtggatcgtctgggctattacccttacatcgacagcattactggggtgaccgtgaacggaggcattcctcagaaaatatcactgcaggaccacctggacaaagctaagaaggatattacattctacatgccagtggacaatctcggaatggctgtgattgactgggaggagtggagacctacttgggcccgaaattggaagcccaaggatgtgtataagaaccgatccattgagctggtgcagcagcagaacgtgcagctgtcccttacagaagccaccgaaaaagctaagcaggaattcgagaaagctgggaaggatttcctggttgagacaataaaacttgggaaactgcttagacctaaccacctctggggctattatttgttccccgattgctacaatcaccactataagaagcccggctacaacggatcttgtttcaacgtcgaaattaaaagaaacgatgacctctcttggttgtggaatgagtctactgcactctacccctctatatatctcaacacacagcagtccccagtagccgctaccctctacgttcggaatagagtgagggaagccatcagggtgtccaagatccccgatgccaaatctcccctcccagtgtttgcctacaccaggatcgtgtttaccgaccaggtgttgaagttcctgagccaggacgagctcgtgtatacttttggcgagacagttgctctgggagcctctgggatcgtgatctggggcactctgagtattatgcgatcaatgaagtcctgcctgctgttggataactacatggagacaatcctgaacccatatatcattaacgtgactttggccgctaagatgtgttcacaggtgctgtgtcaagagcagggagtatgcattaggaagaactggaactcaagcgattatctccatctgaacccagataattttgcaatccagctggaaaagggtggtaaattcactgtccgagggaagcccacactcgaggatctcgaacagtttagtgaaaagttctactgtagctgctatagcactctgagttgtaaggaaaaagccgatgtgaaagacactgatgccgttgacgtttgcatcgccgatggggtgtgtattgacgcctttctcaagccaccaatggagactgaggagccccagatcttttacaacgcctccccctccaccttgagtgctaccatgttctgataaggatcc

SEQ ID NO: 215 - DNA, 1455 bp, Artificial Sequence
  SPAM1-LSAT
gctagcatggacatgagggtaccagcccagctgttgggccttcttctgctttggctccctggggcaaggggacttaacttcagagctccccctgtaatcccaaacgtccccttcctgtgggcatggaacgcccctagcgaattctgtttggggaaatttgacgaacctctggacatgtctctgttttcttttatcggtagccctcgaatcaacgctaccggacagggggtgacaatcttttacgtggatcgtctgggctattacccttacatcgacagcattactggggtgaccgtgaacggaggcattcctcagaaaatatcactgcaggaccacctggacaaagctaagaaggatattacattctacatgccagtggacaatctcggaatggctgtgattgactgggaggagtggagacctacttgggcccgaaattggaagcccaaggatgtgtataagaaccgatccattgagctggtgcagcagcagaacgtgcagctgtcccttacagaagccaccgaaaaagctaagcaggaattcgagaaagctgggaaggatttcctggttgagacaataaaacttgggaaactgcttagacctaaccacctctggggctattatttgttccccgattgctacaatcaccactataagaagcccggctacaacggatcttgtttcaacgtcgaaattaaaagaaacgatgacctctcttggttgtggaatgagtctactgcactctacccctctatatatctcaacacacagcagtccccagtagccgctaccctctacgttcggaatagagtgagggaagccatcagggtgtccaagatccccgatgccaaatctcccctcccagtgtttgcctacaccaggatcgtgtttaccgaccaggtgttgaagttcctgagccaggacgagctcgtgtatacttttggcgagacagttgctctgggagcctctgggatcgtgatctggggcactctgagtattatgcgatcaatgaagtcctgcctgctgttggataactacatggagacaatcctgaacccatatatcattaacgtgactttggccgctaagatgtgttcacaggtgctgtgtcaagagcagggagtatgcattaggaagaactggaactcaagcgattatctccatctgaacccagataattttgcaatccagctggaaaagggtggtaaattcactgtccgagggaagcccacactcgaggatctcgaacagtttagtgaaaagttctactgtagctgctatagcactctgagttgtaaggaaaaagccgatgtgaaagacactgatgccgttgacgtttgcatcgccgatggggtgtgtattgacgcctttctcaagccaccaatggagactgaggagccccagatcttttacaacgcctccccctccaccttgagtgctacctgataaggatcc

The invention claimed is:

1. An extended soluble PH20 hyaluronidase (esPH20), wherein:
the esPH20 polypeptide exhibits hyaluronidase activity at neutral pH;
the esPH20 polypeptide is secreted when expressed in a mammalian cell;
the esPH20 polypeptide is soluble; and
the esPH20 polypeptide is selected from among:
a polypeptide that consists of the sequence of amino acids set forth as amino acid residues 36-495, 36-496, 36-497, 36-498, 36-499 or 36-500 of SEQ ID NO: 107; or
a polypeptide that contains amino acid substitutions in the sequence of amino acids set forth as amino acids 36-495, 36-496, 36-497, 36-498, 36-499 or 36-500 of SEQ ID NO: 107, whereby the amino acid-substituted polypeptide consists of a sequence of amino acids that has at least 95% sequence identity with the corresponding sequence of amino acids set forth as amino acids 36-495, 36-496, 36-497, 36-498, 36-499 or 36-500 of SEQ ID NO: 107.

2. The esPH20 of claim 1 that is N-glycosylated.

3. The esPH20 of claim 2, wherein the esPH20 is N-glycosylated and comprises at least an N-acetylglucosamine moiety linked to each of at least three asparagine (N) residues.

4. The esPH20 of claim 3, wherein the three asparagine residues correspond to amino acid residues 235, 368 and 393 of SEQ ID NO: 107.

5. The esPH20 of claim 3 that is modified by a polymer.

6. The esPH20 of claim 1 that consists of the sequence of amino acids set forth as amino acids 36-495, 36-496, 36-497, 36-498, 36-499 or 36-500 of SEQ ID NO: 107.

7. The esPH20 of claim 1 that is modified by a modification selected from among sialation, albumination, farnesylation, carboxylation, hydroxylation and phosphorylation.

8. The esPH20 of claim 1 that is modified by a polymer.

9. The esPH8 of claim 8, wherein the polymer is dextran or PEG.

10. The esPH20 of claim 1 that is not bifucosylated.

11. The esPH20 of claim 1 that is purified or isolated.

12. A conjugate, comprising the esPH20 of claim 1.

13. The conjugate of claim 12, wherein the esPH20 is conjugated to a moiety selected from among a multimerization domain, toxin, detectable label and drug.

14. The conjugate of claim 13, wherein the esPH20 is conjugated to an Fc domain.

15. The conjugate of claim 12, wherein the conjugated moiety is linked directly or via a linker to the C-terminus or N-terminus of the esPH20.

16. A composition, comprising the esPH20 polypeptide of claim 1.

17. A composition, comprising a plurality of esPH20 polypeptides of claim 1.

18. The composition of claim 16, wherein the esPH20 polypeptide is secreted from CHO cells.

19. The composition of claim 16 that is a pharmaceutical composition.

20. The composition of claim 19 comprising an additional therapeutic agent.

21. The composition of claim 20, wherein the therapeutic agent is selected from among a chemotherapeutic agent, an analgesic agent, an anti-inflammatory agent, an antimicrobial agent, an amoebicidal agent, a trichomonacidal agent, an anti-parkinson agent, an anti-malarial agent, an anticonvulsant agent, an anti-depressant agent, an antiarthritics agent, an anti-fungal agent, an antihypertensive agent, an antipyretic agent, an anti-parasite agent, an antihistamine agent, an alpha-adrenergic agonist agent, an alpha blocker agent, an anesthetic agent, a bronchial dilator agent, a biocide agent, a bactericide agent, a bacteriostat agent, a beta adrenergic blocker agent, a calcium channel blocker agent, a cardiovascular drug agent, a contraceptive agent, a decongestant agent, a diuretic agent, a depressant agent, a diagnostic agent, a electrolyte agent, a hypnotic agent, a hormone agent, a hyperglycemic agent, a muscle relaxant agent, a muscle contractant agent, an ophthalmic agent, a parasympathomimetic agent, a psychic energizer agent, a sedative agent, a sympathomimetic agent, a tranquilizer agent, an urinary agent, a vaginal agent, a viricide agent, a vitamin agent, a non-steroidal anti-inflammatory agent, an angiotensin converting enzyme inhibitor agent, a polypeptide, a protein, a nucleic acid, a drug, an organic molecule and a sleep inducer.

22. The composition of claim 20, wherein the therapeutic agent is selected from among an antibody, an immunoglobulin, a bisphosphonate, a cytokine, a chemotherapeutic agent and an insulin.

23. The composition of claim 22, wherein the insulin is a fast-acting insulin and the bisphosphonate is zoledronic acid.

24. The composition of claim 20, wherein the additional therapeutic agent is selected from among Acivicins; Aclarubicins; Acodazoles; Acronines; Adozelesins; Aldesleukins; Alemtuzumabs; Alitretinoins (9-Cis-Retinoic Acids); Allopurinols; Altretamines; Alvocidibs; Ambazones; Ambomycins; Ametantrones; Amifostines; Aminoglutethimides; Amsacrines; Anastrozoles; Anaxirones; Ancitabines; Anthramycins; Apaziquones; Argimesnas; Arsenic Trioxides; Asparaginases; Asperlins; Atrimustines; Azacitidines; Azetepas; Azotomycins; Banoxantrones; Batabulins; Batimastats; BCG Live; Benaxibines; Bendamustines; Benzodepas; Bexarotenes; Bevacizumab; Bicalutamides; Bietaserpines; Biricodars; Bisantrenes; Bisantrenes; Bisnafide Dimesylates; Bizelesins; Bleomycins; Bortezomibs; Brequinars; Bropirimines; Budotitanes; Busulfans; Cactinomycins; Calusterones; Canertinibs; Capecitabines; Caracemides; Carbetimers; Carboplatins; Carboquones; Carmofurs; Carmustines with Polifeprosans; Carmustines; Carubicins; Carzelesins; Cedefingols; Celecoxibs; Cemadotins; Chlorambucils; Cioteronels; Cirolemycins; Cisplatins; Cladribines; Clanfenurs; Clofarabines; Crisnatols; Cyclophosphamides; Cytarabine liposomals; Cytarabines; Dacarbazines; Dactinomycins; Darbepoetin Alfas; Daunorubicin liposomals; Daunorubicins/Daunomycins; Daunorubicins; Decitabines; Denileukin Diftitoxes; Dexniguldipines; Dexonas; Dexrazoxanes; Dezaguanines; Diaziquones; Dibrospidiums; Dienogests; Dinalins; Disermolides; Docetaxels; Dofequidars; Doxifluridines; Doxorubicin liposomals; Doxorubicin HCL; Doxorubicin HCl liposome injection; Doxorubicins; Droloxifenes; Dromostanolone Propionates; Duazomycins; Ecomustines; Edatrexates; Edotecarins; Eflornithines; Elacridars; Elinafides; Elliott's B Solutions; Elsamitrucins; Emitefurs; Enloplatins; Enpromates; Enzastaurins; Epipropidines; Epirubicins; Epoetin alfas; Eptaloprosts; Erbulozoles; Esorubicins; Estramustines; Etanidazoles; Etoglucids; Etoposide phosphates; Etoposide VP-16s; Etoposides; Etoprines; Exemestanes; Exisulinds; Fadrozoles; Fazarabines; Fenretinides; Filgrastims; Floxuridines; Fludarabines; Fluorouracils; 5-fluorouracils; Fluoxymesterones; Fluorocitabines; Fosquidones; Fostriecins; Fotretamines; Fulvestrants; Galarubicins; Galocitabines; Gemcitabines; Gemtuzumabs/Ozogamicins; Geroquinols; Gimatecans; Gimeracils; Gloxazones; Glufosfamides; Goserelin acetates; Hydroxyureas; Ibritumomabs/ Tiuxetans; Idarubicins; Ifosfamides; Ilmofosines; Ilomastats; Imatinib mesylates; Imexons; Improsulfans; Indisulams; Inproquones; Interferon alfa-2 as; Interferon alfa-2bs; Interferon Alfas; Interferon Betas; Interferon Gammas; Interferons; Interleukin-2s and other Interleukins (including recombinant Interleukins); Intoplicines; Iobenguanes [131-I]; Iproplatins; Irinotecans; Irsogladines; Ixabepilones; Ketotrexates; L-Alanosines; Lanreotides; Lapatinibs; Ledoxantrones; Letrozoles; Leucovorins; Leuprolides; Leuprorelins (Leuprolides); Levamisoles; Lexacalcitols; Liarozoles; Lobaplatins; Lometrexols; Lomustines/CCNUs; Lomustines; Lonafarnibs; Losoxantrones; Lurtotecans; Mafosfamides; Mannosulfans; Marimastats; Masoprocols; Maytansines; Mechlorethamines; Mechlorethamines/Nitrogen mustards; Megestrol acetates; Megestrols; Melengestrols; Melphalans; L-PAMs; Menogarils; Mepitiostanes; Mercaptopurines; 6-Mercaptopurine; Mesnas; Metesinds; Methotrexates; Methoxsalens; Metomidates; Metoprines; Meturedepas; Miboplatins; Miproxifenes; Misonidazoles; Mitindomides; Mitocarcins; Mitocromins; Mitoflaxones; Mitogillins; Mitoguazones; Mitomalcins; Mitomycin Cs; Mitomycins; Mitonafides; Mitoquidones; Mitospers; Mitotanes; Mitoxantrones; Mitozolomides; Mivobulins; Mizoribines; Mofarotenes; Mopidamols; Mubritinibs; Mycophenolic Acids; Nandrolone Phenpropionates; Nedaplatins; Nelarabines; Nemorubicins; Nitracrines; Nocodazoles; Nofetumomabs; Nogalamycins; Nolatrexeds; Nortopixantrones; Octreotides; Oprelvekins; Ormaplatins; Ortataxels; Oteracils; Oxaliplatins; Oxisurans; Oxophenarsines; Paclitaxels; Pamidronates; Patupilones; Pegademases; Pegaspargases; Pegfilgrastims; Peldesines; Peliomycins; Pelitrexols; Pemetrexeds; Pentamustines; Pentostatins; Peplomycins; Perfosfamides; Perifosines; Picoplatins; Pinafides; Pipobromans; Piposulfans; Pirfenidones; Piroxantrones; Pixantrones; Plevitrexeds; Plicamycin Mithramycins; Plicamycins; Plomestanes; Plomestanes; Porfimer sodiums; Porfimers; Porfiromycins; Prednimustines; Procarbazines; Propamidines; Prospidiums; Pumitepas; Puromycins; Pyrazofurins; Quinacrines; Ranimustines; Rasburicases; Riboprines; Ritrosulfans; Rituximabs; Rogletimides; Roquinimexs; Rufocromomycins; Sabarubicins; Safingols; Sargramostims; Satraplatins; Sebriplatins; Semustines; Simtrazenes; Sizofurans; Sobuzoxanes; Sorafenibs; Sparfosates; Sparfosic Acids; Sparsomycins; Spirogermaniums; Spiromustines; Spiroplatins; Spiroplatins; Squalamines; Streptonigrins; Streptovarycins; Streptozocins; Sufosfamides; Sulofenurs; Sunitinib Malate; 6-TG; Tacedinalines; Talcs; Talisomycins; Tallimustines; Tamoxifens; Tariquidars; Tauromustines; Tecogalans; Tegafurs; Teloxantrones; Temoporfins; Temozolomides; Teniposides/VM-26s; Teniposides; Teroxirones; Testolactones; Thiamiprines; Thioguanines; Thiotepas; Tiamiprines; Tiazofurins; Tilomisoles; Tilorones; Timcodars; Timonacics; Tirapazamines; Topixantrones; Topotecans; Toremifenes; Tositumomabs; Trabectedins (Ecteinascidin 743); Trastuzumabs; Trestolones; Tretinoins/ATRA; Triciribines; Trilostanes; Trimetrexates; Triplatin Tetranitrates; Triptorelins; Trofosfamides; Tubulozoles; Ubenimexs; Uracil Mustards; Uredepas; Valrubicins; Valspodars; Vapreotides; Verteporfins; Vinblastines; Vincristines; Vindesines; Vinepidines; Vinflunines; Vinformides; Vinglycinates; Vinleucinols; Vinleurosines; Vinorelbines; Vinrosidines; Vintriptols; Vinzolidines; Vorozoles; Xanthomycin A's (Guamecyclines); Zeniplatins; Zilascorbs [2-H]; Zinostatins; Zoledronate; Zorubicins; and Zosuquidars.

25. A method for treating a hyaluronan-associated disease or condition, due to elevated interstitial fluid pressure, decreased vascular volume, elevated hyaluronan expression, and/or increased water content in a tissue, by administering to a subject the composition of claim 16, wherein the treating results in amelioration or reduction of one or more of increased interstitial fluid pressure, decreased vascular volume, and increased water content in a tissue.

26. A method for increasing penetration of therapeutic agents into tissues by administering to a subject the composition of claim 16.

27. The method of claim 25, wherein the disease or condition is benign prostatic hyperplasia.

28. The method of claim 27, wherein the esPH20 is PEGylated.

29. The esPH20 polypeptide of claim 1 that is N-partially glycosylated.

30. A combination, comprising:
   a first composition containing an esPH20 polypeptide of claim 1; and
   a second composition comprising a therapeutic agent.

31. The esPH20 polypeptide of claim 1 that consists of the sequence of amino acids set forth as amino acid residues 36-495, or a polypeptide that contains amino acid substitutions in the sequence of amino acids set forth as amino acid residues 36-495 of SEQ ID NO: 107, whereby the amino acid-substituted polypeptide consists of a sequence of amino acids that has at least 95% sequence identity with the sequence of amino acids set forth as amino acid residues 36-495 and exhibits hyaluronidase activity at neutral pH.

32. The esPH20 polypeptide of claim 1 that consists of the sequence of amino acids set forth as amino acid residues 36-496, or a polypeptide that contains amino acid substitutions in the sequence of amino acids set forth as amino acid residues 36-496 of SEQ ID NO: 107, whereby the amino acid-substituted polypeptide consists of a sequence of amino acids that has at least 95% sequence identity with the sequence of amino acids set forth as amino acid residues 36-496 and exhibits hyaluronidase activity at neutral pH.

33. The esPH20 polypeptide of claim 1 that consists of the sequence of amino acids set forth as amino acid residues 36-497, or a polypeptide that contains amino acid substitutions in the sequence of amino acids set forth as amino acid residues 36-497 of SEQ ID NO: 107, whereby the amino acid-substituted polypeptide consists of a sequence of amino acids that has at least 95% sequence identity with the sequence of amino acids set forth as amino acid residues 36-497 and exhibits hyaluronidase activity at neutral pH.

34. The esPH20 polypeptide of claim 1 that consists of the sequence of amino acids set forth as amino acid residues 36-498, or a polypeptide that contains amino acid substitutions in the sequence of amino acids set forth as amino acid residues 36-498 of SEQ ID NO: 107, whereby the amino acid-substituted polypeptide consists of a sequence of amino acids that has at least 95% sequence identity with the sequence of amino acids set forth as amino acid residues 36-498 and exhibits hyaluronidase activity at neutral pH.

35. The esPH20 polypeptide of claim 1 that consists of the sequence of amino acids set forth as amino acid residues 36-499, or a polypeptide that contains amino acid substitutions in the sequence of amino acids set forth as amino acid residues 36-499 of SEQ ID NO: 107, whereby the amino acid-substituted polypeptide consists of a sequence of amino acids that has at least 95% sequence identity with the sequence of amino acids set forth as amino acid residues 36-499 and exhibits hyaluronidase activity at neutral pH.

36. The esPH20 polypeptide of claim 1 that consists of the sequence of amino acids set forth as amino acid residues 36-500, or a polypeptide that contains amino acid substitutions in the sequence of amino acids set forth as amino acid residues 36-500 of SEQ ID NO: 107, whereby the amino acid-substituted polypeptide consists of a sequence of amino acids that has at least 95% sequence identity with the sequence of amino acids set forth as amino acid residues 36-500 and exhibits hyaluronidase activity at neutral pH.

37. The polypeptide of claim 1, wherein the mammalian cell is a CHO cell.

\* \* \* \* \*

UNITED STATES PATENT AND TRADEMARK OFFICE
CERTIFICATE OF CORRECTION

| | |
|---|---|
| PATENT NO. | : 8,927,249 B2 |
| APPLICATION NO. | : 12/653245 |
| DATED | : January 6, 2015 |
| INVENTOR(S) | : Wei et al. |

It is certified that error appears in the above-identified patent and that said Letters Patent is hereby corrected as shown below:

IN THE TITLE PAGES:

In Item (56) References Cited, in OTHER PUBLICATIONS, at page 2, column 2, line 67, please replace "Gohllce" with —Gohlke—.

IN THE CLAIMS:

Column 122, line 22 to Column 123, line 61, should read

24. The composition of claim 20, wherein the additional therapeutic agent is selected from among Acivicins; Aclarubicins; Acodazoles; Acronines; Adozelesins; Aldesleukins; Alemtuzumabs; Alitretinoins (9-Cis-Retinoic Acids); Allopurinols; Altretamines; Alvocidibs; Ambazones; Ambomycins; Ametantrones; Amifostines; Aminoglutethimides; Amsacrines; Anastrozoles; Anaxirones; Ancitabines; Anthramycins; Apaziquones; Argimesnas; Arsenic Trioxides; Asparaginases; Asperlins; Atrimustines; Azacitidines; Azetepas; Azotomycins; Banoxantrones; Batabulins; Batimastats; BCG Live; Benaxibines; Bendamustines; Benzodepas; Bexarotenes; Bevacizumab; Bicalutamides; Bietaserpines; Biricodars; Bisantrenes; Bisantrenes; Bisnafide Dimesylates; Bizelesins; Bleomycins; Bortezomibs; Brequinars; Bropirimines; Budotitanes; Busulfans; Cactinomycins; Calusterones; Canertinibs; Capecitabines; Caracemides; Carbetimers; Carboplatins; Carboquones; Carmofurs; Carmustines with Polifeprosans; Carmustines; Carubicins; Carzelesins; Cedefingols; Celecoxibs; Cemadotins; Chlorambucils; Cioteronels; Cirolemycins; Cisplatins; Cladribines; Clanfenurs; Clofarabines; Crisnatols; Cyclophosphamides; Cytarabine liposomals; Cytarabines; Dacarbazines; Dactinomycins; Darbepoetin Alfas; Daunorubicin liposomals;

Signed and Sealed this
Nineteenth Day of January, 2016

Michelle K. Lee
*Director of the United States Patent and Trademark Office*

Daunorubicins/Daunomycins; Daunombicins; Decitabines; Denileukin Diftitoxes; Dexniguldipines; Dexonas; Dexrazoxanes; Dezaguanines; Diaziquones; Dibrospidiums; Dienogests; Dinalins; Disermolides; Docetaxels; Dofequidars; Doxifluridines; Doxorubicin liposomals; Doxorubicin HCL; Doxorubicin HCl liposome injection; Doxorubicins; Droloxifenes; Dromostanolone Propionates; Duazomycins; Ecomustines; Edatrexates; Edotecarins; Eflornithines; Elacridars; Elinafides; Elliott's B Solutions; Elsamitrucins; Emitefurs; Enloplatins; Enpromates; Enzastaurins; Epipropidines; Epirubicins; Epoetin alfas; Eptaloprosts; Erbulozoles; Esorubicins; Estramustines; Etanidazoles; Etoglucids; Etoposide phosphates; Etoposide VP-16s; Etoposides; Etoprines; Exemestanes; Exisulinds; Fadrozoles; Fazarabines; Fenretinides; Filgrastims; Floxuridines; Fludarabines; Fluorouracils; 5-fluorouracils; Fluoxymesterones; Fluorocitabines; Fosquidones; Fostriecins; Fotretamines; Fulvestrants; Galarubicins; Galocitabines; Gemcitabines; Gemtuzumabs/Ozogamicins; Geroquinols; Gimatecans; Gimeracils; Gloxazones; Glufosfamides; Goserelin acetates; Hydroxyureas; Ibritumomabs/Tiuxetans; Idarubicins; Ifosfamides; Ilmofosines; Ilomastats; Imatinib mesylates; Imexons; Improsulfans; Indisulams; Inproquones; Interferon alfa-2as Interferon alfa-2bs; Interferon Alfas; Interferon Betas; Interferon Gammas; Interferons; Interleukin-2s and other Interleukins (including recombinant Interleukins); Intoplicines; Iobenguanes [131-I]; Iproplatins; Irinotecans; Irsogladines; Ixabepilones; Ketotrexates; L-Alanosines; Lanreotides; Lapatinibs; Ledoxantrones; Letrozoles; Leucovorins; Leuprolides; Leuprorelins (Leuprolides); Levamisoles; Lexacalcitols; Liarozoles; Lobaplatins; Lometrexols; Lomustines/CCNUs; Lomustines; Lonafarnibs; Losoxantrones; Lurtotecans; Mafosfamides; Mannosulfans; Marimastats; Masoprocols; Maytansines; Mechlorethamines; Mechlorethamines/Nitrogen mustards; Megestrol acetates; Megestrols; Melengestrols; Melphalans; L-PAMs; Menogarils; Mepitiostanes; Mercaptopurines; 6-Mercaptopurine; Mesnas; Metesinds; Methotrexates; Methoxsalens; Metomidates; Metoprines; Meturedepas; Miboplatins; Miproxifenes; Misonidazoles; Mitindomides; Mitocarcins; Mitocromins; Mitoflaxones; Mitogillins; Mitoguazones; Mitomalcins; Mitomycin Cs; Mitomycins; Mitonafides; Mitoquidones; Mitospers; Mitotanes; Mitoxantrones; Mitozolomides; Mivobulins; Mizoribines; Mofarotenes; Mopidamols; Mubritinibs; Mycophenolic Acids; Nandrolone Phenpropionates; Nedaplatins; Nelarabines; Nemorubicins; Nitracrines; Nocodazoles; Nofetumomabs; Nogalamycins; Nolatrexeds; Nortopixantrones; Octreotides; Oprelvekins; Ormaplatins; Ortataxels; Oteracils; Oxaliplatins; Oxisurans; Oxophenarsines; Paclitaxels; Pamidronates; Patupilones; Pegademases; Pegaspargases; Pegfilgrastims; Peldesines;

CERTIFICATE OF CORRECTION (continued)
U.S. Pat. No. 8,927,249 B2

Peliomycins; Pelitrexols; Pemetrexeds; Pentamustines; Pentostatins; Peplomycins; Perfosfamides; Perifosines; Picoplatins; Pinafides; Pipobromans; Piposulfans; Pirfenidones; Piroxantrones; Pixantrones; Plevitrexeds; Plicamycin Mithramycins; Plicamycins; Plomestanes; Plomestanes; Porfimer sodiums; Porfimers; Porfiromycins; Prednimustines; Procarbazines; Propamidines; Prospidiums; Pumitepas; Puromycins; Pyrazofurins; Quinacrines; Ranimustines; Rasburicases; Riboprines; Ritrosulfans; Rituximabs; Rogletimides; Roquinimexs; Rufocromomycins; Sabarubicins; Safingols; Sargramostims; Satraplatins; Sebriplatins; Semustines; Simtrazenes; Sizofurans; Sobuzoxanes; Sorafenibs; Sparfosates; Sparfosic Acids; Sparsomycins; Spirogermaniums; Spiromustines; Spiroplatins; Spiroplatins; Squalamines; Streptonigrins; Streptovarycins; Streptozocins; Sufosfamides; Sulofenurs; Sunitinib Malate; 6-TG; Tacedinalines; Talcs; Talisomycins; Tallimustines; Tamoxifens; Tariquidars; Tauromustines; Tecogalans; Tegafurs; Teloxantrones; Temoporfins; Temozolomides; Teniposides/VM-26s; Teniposides; Teroxirones; Testolactones; Thiamiprines; Thioguanines; Thiotepas; Tiamiprines; Tiazofurins; Tilomisoles; Tilorones; Timcodars; Timonacics; Tirapazamines; Topixantrones; Topotecans; Toremifenes; Tositumomabs; Trabectedins (Ecteinascidin 743); Trastuzumabs; Trestolones; Tretinoins/ATRA; Triciribines; Trilostanes; Trimetrexates; Triplatin Tetranitrates; Triptorelins; Trofosfamides; Tubulozoles; Ubenimexs; Uracil Mustards; Uredepas; Valrubicins; Valspodars; Vapreotides; Verteporfins; Vinblastines; Vincristines; Vindesines; Vinepidines; Vinflunines; Vinformides; Vinglycinates; Vinleucinols; Vinleurosines; Vinorelbines; Vinrosidines; Vintriptols; Vinzolidines; Vorozoles; Xanthomycin A's (Guamecyclines); Zeniplatins; Zilascorbs [2-H]; Zinostatins; Zoledronate; Zorubicins; and Zosuquidars.

UNITED STATES PATENT AND TRADEMARK OFFICE
CERTIFICATE OF CORRECTION

PATENT NO. : 8,927,249 B2
APPLICATION NO. : 12/653245
DATED : January 6, 2015
INVENTOR(S) : Wei et al.

Page 1 of 1

It is certified that error appears in the above-identified patent and that said Letters Patent is hereby corrected as shown below:

On the Title Page:

The first or sole Notice should read --

Subject to any disclaimer, the term of this patent is extended or adjusted under 35 U.S.C. 154(b) by 701 days.

Signed and Sealed this
Twenty-eighth Day of June, 2016

Michelle K. Lee
*Director of the United States Patent and Trademark Office*